United States Patent 12,098,361 (ATTENUATED HISTOMONAS MELEAGRIDIS STRAIN AND VACCINE) - sequence listing, part 2

SEQ ID NO: 27 - DNA, 414718 bp, Histomonas meleagridis
  misc_feature: contig_20_att
atcattgaccaagtccccacatggcaagacgcaccggaaagtccgctttatagtttcctgaaccttcatgatcaaacctctttttcctcttcctctataccgattccttttcccatttggtcgagcgcacttttggtgaacttttaattgaaattcaaaatgaagattttaagttgcttttccaacttgtggctattgaaacattattatttttttcacttagaaaagaacatgccaattcttaaagtcaagatgatgatggaatattagatcatctggaagaagaagaaaaggttgaaattgaccgtttgtaattcaggtgccctaatgttgcttgcacaaaatgtctctgaactaaacttaagtagttcggaattcataacttttcttgcaatgccccagtgcaacaatttgttgatactatcaataatgtttcatgggagtttcgacaaggaggaccagttgaaagagataagcagttataataatatcaggaatatatgacacaacaaattcaatgtacattattggcgatggtttaatcaagtctgggtatcgtgtttaaatgctcaacttgtactctccactccagaatcggttctcaattcttacaggttttgatcttcttactgcatccaaaaatgatttccaaagtccatctcgttgggtttggctttggtggattacagcgcacatctttatcttttcattctgctttcagcgaaattatttcacttacattaatagctagcatatgaaccaagttattcaatcattcagttagtttctttactgctttaacaggaaaaggcgatttaattgatgaagtatccaggggaatttaccagaccttgaagaatccaccaaattcattataaatgaaatcaagagtttgccagctctgtcgtcagtgctcgaatcacatgcgtgccaaagcgcccagggcaccccttcccaagctatcggccgatagaattcttatcgttcaaccgacagattgggccgaattttcatccagttttggctggagagcctctagtcgaagaaattgattaataaatttgaaaatttagtaaaaaagaaatggggaaaaatgaacaatttccgtataaatttaaaaatattttgaaattttgaattttttttttgggaattacgattttggcaggtagcttaaggctaaatgcaattaaaatacaacaccaaatacaaaaaagaaaatttaaatcacaaaaaaaaacattagaaacggttttgatcggcatgtactctatccaaaatttataatttttaagtatttttattatataacataaaatgagtagaatatctagtcgtaaccatcgtcatcatccaaattgtcattatctacataatagtataatcatcatcagaagaatcaccgtcttcatcatcatcttctaattcggatgactctgtcgttttaaacagagctcccctgtttggaatcttcttgtgcttgttggagacctccaactttgtatttgatccttctcatcatcgagattatcttgctcaagacgaccgacggccctggaggtggaggagaaggagcccagtttggagaatttgtatttctgacaggattgagtaaaattaaattatttggattcaatgtagaatttcttgatcacctgtaaatgttgttccaaaaccaattacccaatctaatggagggttaggaggaaaggggattattaaattgagaatcgatattaaaatgaagaagaactaaaaccattaagcccacctccaacaaaaccacgattactaccgtggaaggaggtggtggtacaaggtatttgttcccattaaaatcaataagttccgatgtgaaagaaaccaaaattcgctgggtctatggaattttcatggataagactgatttctacgttttgaggcggttgtttggtgagccttctggtttaaaggatcatcatttaataggttatgtaataaatcaaaattaatcttactttctgtgctaccttcctctgtagatttaatgttaaagcattttcaacaatttcatacattttaatttaaatctgttgaattacagttgccgatgtcagaatcttcaccaaaaacgtacagttacgtacccggaaacgtaacacttttatttcctcattaggatcagacgaataactaaaatttgattccaaaagggattaattacagatttatcaatcctcttgattgtgtaatgtccctgctttgaatttaaatcagcgtaacatgaagattctattgtgtcaaattattttccttggaagattggatgctgagttaattcttaagcaagagtttcatttggctaaaaataaccgccaacgaggtggaggaacttaataacttttgataaatcatagaataatttcatccattttgaaaacgttatagtgcgatacaactcaaaaattgtcaaatctacttggaacaaaaatataactttattgatttattaaaaattaaaatttgaaagtataatcattttgcgtcttattatgagccaaatatgaaaatcttatttaaatagtctatacgcgttttcaagtttcttctttttttttatctatatttcatataacatgtctcatatagattcataaaaatgagcactcagaaaagccatcataaaagtcattcacataaatccaagaaatctgaagtagaaaacagtgaagaaatttcagcagatgcttcaaaggaattagattgtttcgacgtcgtcctgaaattagagatgtgggttgcagggttgatcaattactcgggctgcaacactctcatcgctttgtttcgagatcgtcgtctttatcctcaagaaaggaagtatatgtcacttgtccttccaccacctcgaacttttaggtctaactcaaacagcttcagcccttactgactcattttgaattcccaatatatgcacctgatcatccatcagatcttcccaacttcttcatcatcttgagcgtggtgttcttagtgccgatcgtttctggaattttactttttgctctgccatgtcttatcccactgaaaattgaagctgttcaaaagcagttgcgtcaacaaaccagtgccgttttaggtgttgttgttgggcaaacgaccgaatcccaaccattaaatcaagaaaagctcgaagatttgagagtcaattgagtttgatgaagataccaaatgccctcaaaggcaccatcaatcagcttgtatgggttgctgcggagtcgattttatcccaaacttagccctcgtaatatgttgaaattttcacgacgacatatcagcggaccatatgtcatcatttcaaatgttacaaaaacttcaagaaagcatggccactcatagctcaatcaaagagccgcctaagaaagattgcacggcaagagacaaagatgagctacaatttgttgtgtgtggagtggatggatcgaaaacatggatttcttcgatttcgatgccgctttactcaaaacttaacacaatggctttccaccattaatactcgtcgacagacatcacaaaagcgtatgttgaatgttcttcaaaagcaaatcgaaggaaaatcgagcgatgacttcttatcgcattccaaattcgacttaagtaatgttaaaattccggagaaattatttttgtcgcaattcactttaatgtcattagatgtcagtgttctagcgcgacaaatcgtaatgtccagtgcgaagtattactattcgatcacaccaaaagaattattggattgcgcatggagcaagccgagcattcgacatcgctcaccgaatgttgttgcgttaactaataacttcaatgtcattgcagattgggtcaatataacatattatgttcggaaacaattgattcgcgtttagaagcgtttaagttcttttcgcaattagctaaagagttatggcaactacacgattacttggacggcatagctatagcgacggcaatgaactcgaacgcgatctttaggttaaagcatcacttagagtcattgccagaaaatgtgatggagccaattcacgaaatcctcgacgcgataaagagcgatgataacttcgcaaagattcgtaacattcatgacgaaggacaaaagagtggtccgtgtcttccatacattggcgtttacttgacacaattgactttcttctatgatggtaataaggattacatcgacgatttggtcaactacaataagtgcataggcatattcaagctgatcgataagatacaaagcttccaaatcaaacaattcaacttcgtggtgatagagcaaatacaagaaaagttgtcggaaattgtaatgcacgacgaaagcgaactgtacgcaaagagcttgagcgtagagcccggtaaggtgacggcggaagaattcgagcaaatgagactcaaggaaagagcggaaaaaggacagtaaaaaatgattaattttattttgcgaattgatcaaaattttttggtgtttagcgttacgataattgttggaatgtttgatgatcatccagatggaaataaagaaaattcagtggggttatcaattaatattggtacgtactgtttagagtatattttttgcggtatgaatatgtttttattcaaatatcaggttttatatggcgcatatacattttgaaatttattaaataatgtcaatatatgtaaaaatgaataaataaaatatatataagaatttaattacgttcgccacgaattctttgagcaagttgaacatcacgttccataattgtaacacgatttgcatgaattgcacaaagattcgtatcttcgaaaagaccaacaaggtaagcttcggatgcttcttggagagctgcaattgctgatgattggaaacgaagatcaccacggaaaccagatgcgatttcacgaacaagacgttggaatggaagcttacggataagaagatctgtgctcttttggtatttacgaatttcacgaagagcaactgtacctggcctgaaacgatgttgcttcttagcaccttgtgaatcaacaactggtgttgacttacgagctgccttagcaccgagtgatttacgtggagtcttaccaccagtagatttacgagctgtttgttttgtacgagccatgagaaaaatgaacagataaattttcccgccttttcggagaaagaattaatagaaaatgacaaaattgatattcaatttttattggtgtaaaatgtcagtcaatatggcatataatattggggccaatattaaattttaaataaagggataactgacaaattcgaagtgcaaaatctcccaaatcaagtcggaccttatcacatgcaaaacaccgttagcgacgatgatgaagattcgataataaaagaatgtgttcatcaagaaagtaatcagaaatatatctgcaaaattatgccaaaaaaacttgatgataaagagtaagagaaacacattgaactacaaaaagaaatcaatcaacaacttcaccatccaggaattgtggaaatgattgattttctttctgataaaaattattattattttatttttgaatattgcccaaatggagatttatttgattatttaatgaataaaggccatcttgatgaaagtgaagcaaaaccaattttccgacagattctcgaagctgtccaatacatccattctaatagagttgcacatcgtaacctcaaagtagaaagtattttaattgatgagtcatggcaatttaaaatcacgaattttattctcgctaattttgttgataggaataacttagttaagactccatgtggaagtccatgctatgcatctcccgaatgtattagtgggcagccttacaatgggttcactagtgatgtatggagttgtggtgtcatattattcgtcatgttaaccggaagtttcccatggactaaaagaaaacaagcggagcttttcacacaaatccgtaatggaaggtttacgattccctctaaactcagtcccgaggcgcaaaacatcatcaaaaaattgatgaccgtaaatcctatcgaacgatacactattgaagatgctcttagtgacccatggctatcataatattttagtaggttaaaatgaataatgaatactttcaactggtggcaatcgtgtacatattttaatgatttaaaaacattggtttctatatacctaaattttgaattgttttcattttttgttaaaacttaagttattggaaaaagaattttttagaaaaagcactttggtttttgttcaatttaatcgtgaaaaaatacataatttatttagaatcttttaaaaaaaaaataagaaatatttaaatatacaaaactaaatatatcttctctatataagtgatatcaacagagatatcttgtcaagacgattaattatttatctgaaattagtcatacataatgattccaattacttcttgaacaaaaaggaattattatcaatgcgaaagataaacattcattaataatgatcaaggcccatataattgaaaatgattcatatatgtcttttcgttatctccccagttctgtactacatcaagatgcatggaattgaagagaatgtctgtttccaaatcaaatgcaattcgccaattctgaatattcatttggaagatcaaaagtatgcgtcttgaaaactaaatcattttgtaagtaaaaaagtaaccgaaattgtcgaattgttgatgacacatgtgtaacagaaattggagaaaaaattatatgtcgggctaagcataaagtaatggctttaaacttgaaaattggagaattctgcttgcctgtaaaagatggagcaatgtttgatggaagcttttcttttttttcgaaatattttaaatggcatgagaaaattaaaatattgtttcgttcttgatgaattaatatcaacaagagataatggtataatgctctcttctcttgtttttaaagtgtttgaacttgattgatttattaattcatttaatttttcacgagctaatgttaaatttgtcaactcccagaaaacctgccctatctttagggtttcttcttttaccatattttctatttcttcacataaagaagatgtacataataatatggagatcatttcaaaataaaaaagtgtatcctaaagtgatcaaattcgaaaatttatctattttaatgatgaaccccaaggatatcaaaattttacataaaattcattttttgaaaaatttttatttaaggatattttattactactaattttgtttttaaggaaaataatttttttgcccatcaaataatgatttaaaatcatatgttttatatttgtggtatattcatttctttaaatgtctttgtacagatcttatttaagttgaccaatttagtgatgtattttttgtatccaaagagaaacgaaaacttatatcttattaataataaaattatttttgaattatttatttacctttgtttcctgaattatttcattttatgaatttgttcaccaagccaatctaatccttcatacaaaccatctcctgttgttgcacatgttccttgaacttgccatggacgatttgtgattgtgttaagttttaatctatttcctaattccattggcttaactgcatttggaagatcttgtttgttagcataaacaagtaaaactgaattacgtaattcatcttcttccagaagtctatgtaaaacatcacgtgcttcatcaattcttccgatatcattagaatcaacaacaaaaataagtccttgtgtattgtggaaataatgtctccaaagtggtcgaattcgatcttgacctccaacatcccatacattcatgttaagtcctttgtattcaaatgtttcaacattaaaaccaattgttggaattgttgttacttgttctccaagtttaagtttatataaaactgtggtttttcctgctgcatcaagtcctaacataagaattcttgtttctttgttcttaaaccatttgttatatatatcactgaagaataaacccattgtattaatgatgtgactgaatgcttgatcaacacatttctacaactttccatctgaccaaaatcgagatttaacgatagaaaaatttaaacgttctatttcacgtcacttttccctctttaagcaaatttgcttggcttaaatttagatttaatgacatatgcaaattgattttttttaatattttctgtgatcgttcccgtagtaaatatactggctgataaaacaacactttcttcaattttagtttctttttacgaaaaagaattaatgtcactgctactattgcacaaataacaattggaacacaaaccccaataaaagtattattattatcatttgtttgttcataatcattttgataaaaaatagtaaagaaataactaatgtattcaatataaatgatttaataagtgcaactgtttgtgatattgtatatgttaacattttaaaatgaatgataaatcgttacattatattgatatttacttgtaaaagtattcgattgtaaaaatatttttgttctaaagtatagtaatctttaatcctatactgatggtaaaatcaccaaattgtccaactataatctatatgtatcaaatgtcattactttacttaaacaaacattaaaactaaatttgggatatatatatatatatatatatattttaagatccgataaattccatttgtaattcatttaggatatatcataatcattgatattattatcataaaaaattcatcattttcataattagatactttaatatgatgaagatttatacataaagaaaaagctttctgtgatattgatgaaactgatgatgaaattgttgtattattcaaattattggaatcactaaatacatgatctttaaatgctatatagcattgttcaaataatatatttgattttctgaagaaatgttaataatttgaaaaattccacatgaaataagtatgtgatggtaatgctgtactgaagcgtgaatttttatgttattcaaggaataacaaatgtcaaatgcaatttccccaatttttctccgagtgtaacaatttccaattttagcaatcatatcaaaaatggtcattaattgaaagtacttttaaataagaagtgagcaaatgtataaagaatcaattcctttaagatttgatatatttataaataaccagaagtatttttggacaatatttcacatttcttttgcgatttataaattgttaaaaaattttactttgtttaattcaatccaaacatcataaagaaatgaatctttatgaaaacatttattctcagtcatccaatggctgcaaaattctttcagaagatgctcttctacttcgatagcccggactcgatcttcttctcttactaacgacgcctgcgctcttcagtgtctcaaacacttccctcatcttgagatacgccttgtgctgccttccttcgacgtgttctgccattcgcccttccatatcgctttgtttgataaccgctgtacagacttcgcaaatcgtaattttggattccttttcggcattgattttacgaagttcgtcttctttgttcaaatattgttgtttgacagtatctgcattatcatataatgctcgagctcgtgcaacatctccattaacaccacactctcgacactgttcaagtagggccttagcccgcttctccatttcgcgtaattgaggattttcttgatgttcagatgctttattatcccgaagattcttggaaaaggcaatgtgcttgtcggctaaacgaagaataccttctaagatatcataaagttgttggtcatatgtagttttcattccgtttctatctttctggtatttttctttgagatgtttgggtgcaggacatattttataacgacatggttgacgagccattctggtgtggaggagtaatgtataaggacagcaacctgcaagatctaatttgcatattctttcatcattataatcagtgataacatcaactgcagaatcaccattacggtcagcgcccatccaatcgtcaagcatcttttcgaattctgcatatttataacttgtgtatttcatgtcgtgatttaattactcgaacaaataaactctgaaaaactggattttgaatggttcagcattttttccttcattaagctaaaaacgaagaatggttgaatattttaaacaaagagtaacataataaattcataacactacaaaaataaaagggctaagatttttttttcatttaaataaaagtattaatcttaaaatttaataatttcccaaaagaattataaattgtaagtctaataatgtttgcccttgttaaaaaaaaacaaaaaatgttttttaatcacagataattttcattgacgcggtccaagaattttgaacataggtaaacaggttttctctggctcgccccagttctgaattatatttgcttctactttatcaaatactacaacagtttcgagatcaaatagaagctgagctgaacacccatttggaaaatcaatcacacttgactttttcatgaatttgttatgatagtaaaagtcaaaacggatttgccttggaacacattttgagcttggtgtcggagaaatgagaatttgactggcaacagaatctgtaggagttttaaatgtaaaaattggcgcaaaccccttcccaattatacatggaggaaaagattcaggaattgtattatttgatgaaaaaagccgaaagggtttcatcaaactattatattcatcagttcttgatgaatttattgaagaaagtgaaacaggtttttcttctaaagattgcatggattttttggaaacagtagggattatgaatttaagtcttgttttgattacttcgagttttttaaaaagttcgtcgatattagaaattttgttctgtagcttgttggaaatatcatcaattgtgtctttattatagacaaattgcaacaaaaaaaaaatcatgtttaattttatgccaaaattaaaaatatacaatttttaatgtctttcaaaatcattagccgatagaaacaccaatatttcttgtttgatttcttcattaacacttgaaactgacattaatcgtttttccattatgaacggtattaaagaacattgtattttcagaaaaagattccaacaattaattggaaaaagaaattattttttgcaataactttaaatttatatttttatttataataccttccaatgaggaaattctttattttctttctttaatttttcagcatattgtgcaagcatatcaatagcatcgccacaagtcatcttaaaatcgacattttgtaatccgtaaattattgttttgttaattatttgagcatctttcaatgtcaattcctgcgcattatatctaaagttagaaatcaaatcatttctaccataatcatcttcgactgtaaatgttaaacaagaagttaaacctaaaactttaggcgctgcaagcgttgcattaataaatacgtcggaaaatgtgtcattcaatttgaatcttccaacatgagaaagttcaactgcaggcccaatatgtttaacattattttctttagctaagccttcttcaacaattttaagataaccaaaatgaaggcctgtatcgacttgattcttaaaatcatatcgaagtcgattcataaattcacttacagtggtgtttctatctgcttcagctccaacagtaagccatgaaaatgcatttccaataccaaaatgaatttgatcaagatatggtcgaagattaatacatgtagagcatgctttctcattaaatgtaccattaagtgcagcagcagtaaggataagctgagcccataaactatctgtaagtcgatgaatttcacccttagaatttgaacatttaagtgctcgtaaaggcgtttgtaagtaataactttgtgtaagatcaatattacttaagctaagtggatctattgttttaactcgtgaaagccttggatcagatgtaacaaattttggtggtaaagttgcctccttaatatgcttttcaaaggttttaccaattggggttattgcatttgggacaatatcagcagattcgtcttttaacgcattaaataggcgttgtaaaaaggcaccatccgcgcaaagatgacatgaatgaaacactatcgtgttaccagttgtacctatggatgcaagagcttgtgaaactggacgggtatgcttttctgacatgtaatcacatgcttgttttaatcctaaccctgatgggatagaatatattggaacctcttgttcactaacaagtagtttttcattgtcaataactctggttcttaaccctaatgcatatttcttaagtttctgaattgttggtagaacttgatcagaattctttactttgagcgccatttgtacataggctttgatgtcaatgtgatacttctcaaatgctgcgagaggacgaatcattgtgatctgttttgctggacaggtgccagaacacaatatttatcgtattttcattcaaattataattttcgataaattttcaattagagttgaatggcatgccaagctatcggctaaaattgaacacaattttttgaaagattttcgctttcatataaagcgcttttttcaaaacgggaatgccacatgacatgaacgtgcaaaatattaatgacttacaatattaatgacaattgtctaatgattttacatttgttgtagcatatttaatatgaaaaaattgatcataccatttataaattctaaatgtgaaatccaataccaacttcttcactttcataaaagttttatttgttaaatggatattacatttgataatacataaatttaatcaaccaatttttgaagaaaacacattgggcacaaaaaagtgcaaatttgactttgacaaaagtgtcaaaaagtatttgatggatttatctgttcttaatgaatatgaattacagataacaatattagcttgtcatatttctttaaaatatcttgtaattattagttgctacatactgtaagcaatagctaaaaaatcccttcatagtgtgataaatttaattacttgaagtttcatcaatcggatgtaaaatttcgagctgtaagcctttagtcatggtagaaaaggataaatttaaatcgaattttaggtcatatataaactttgtttagtatatgaatgtttggcaatatgcattcttagaaaccttgggcgttaatataaaatcaaaataataacaataaattttttaccaatcaaatgatttaatatttaatgattaaaaaaagtttaataataatagccttttgttgtctaagctcagttcatgctaaaaagaagtcagttattctaataacttctgatttgttaaatcattaaaaatatgatactagagaacattcttcataacccatgtggctcaatgtaaggttaaatcttgcatcttatggtagataataaaacatatttttctaaatttcatgtaatcaattgatacagtcagaggtgaaatttcattagatgatcttcaaccttggtaatacagaaaataaagccgaaaaattgtttttaatacatgattatcaccggaaaactcaaaacgcaacctatcgttccgatgattttttggtgtgacataagttcattcaggtcacttcaaaagaaatttgaatgtggaaaacggctactcatttaattaccgaattctaattgaaattttgagaacttgcatctgacaagcagaaaagtgttttacttcattttttaagatgccaccaagaggtccaccaccaccacatcatccaggcccaccaggtccaccaccacaccatcacccaccaggcccaccaggtccaccacctcatcatccaccaggtccaccaccacatcatccaccaccacatcatcattaaacactcaaatgatgaatttattcatttttaatctgctttttcaaatacgatcaatgatctttgactaatttttgtaaatttttataaatactttttagatctttattgaagtacatcgcttcagatatccttttaatgaatcttttcacgtctttagctaaacatatgcataatttgatcacctactttactattatctgtgtttgtaattttaatatgaaaaaatttgatattaatataatttgaacttcaaataaaattaagcttagcaaatgatttcgaattacataaaaaaaatgtaactcaattaataactactgataaaaaatattgttttatttaatttaatgaataccagagggatgcttaataaatgatataatcacaaaaattattatcgagtttattaatgaagtaaaggttttaagcagtattttttggaccaatcaaatgtttcaaacatttacttatgaatgtgcaaaattagataacacaggtgaatatgcaattgcaggtggaaatgaagaaataattcatttatgtgaacaaaatcattcatcatttaataatgcttatgtaacagcaattcaatttcagcgaaagatatctttcattatttttatgataatattaatgctaaagatatttatttgttttgattaatacttttaataaattgaaaattgaaaatattttttggaaattatttcaattattttatacagcacttattgaagcatctgaaaatagccatatcgaaatagagaaggaattgatattaacgataaaaatatttatttataatatgttttaataattttttgtttcaaaataatatttgaaaattatttcaaatatttgaaacatcacttatggtattttattataacgggcattcgttaatattttctatttaataaattaaatgaagaagatcttccagtttttatatacgagtaattagaaaactttttatatattttaatacgtttgaatgcaatatctttagaaaaaaaatcaatgctttgcaggttatgttgaatcttttgtattagttaaaaaatcaatctaggttctaaatatattcaatgaaatataaaataaaagcaaatcccttctgtcaatttgaaacagaatattctgtcttttttattcaatataaaaaggataaatttgatttttgaatttttatgtttataattttaatattatctgtaattatgtttttttaaatgaacgaacaacctttcatatgaataaccaaatgaatttataagttttatttaaaaaacaaactaaatagaagtttccaaatgaccgtttattatccgaggctgtcctcaaattaagattcacattggccataagtccactttttaagatccggtcaaaaagcgaaaaatacattcaattaattatatgagatcattaaaaactgggctcgtggtcgtcaaaaaattgaatcgtttattacaaggccaaagattcagttcactttgtttattgtcccatgggtaaggagaaagaacatatcaatctcgtcgttatcggacacgtcgatgctggtaaatccacaaccacaggtcacttaatctacaagtgcggtggtatcgataagagaaagctcgcccaaatcgaaaaggaagccgtccaacttggtaagggttccttcaaatatgccttcgttatggataacctcaaggccgaacgtgaacgtggtatcacaatcgatatctccctttggaaattcgaatcaccaaaatacatgttcaccatcattgatgctccaggacacagagacttcatcaagaacatgatcacaggtacatcccaagccgatgctgccgtccttgttattgatgccacacgcggtggttttgaagccggtattgccgaacaaggccaaacccgtgaacacgctcttcttgccttcacccttggtatcaagcaagttattgttggtgttaacaagatggatgacaacacagtcaactactccaagcaacgttatgatgaaatcgtccaagaaatgacacacatccttggtaacattggtttcaagccagaacaatacaagttcgttccaatctccggatttgtcggtgataacatgaccgaaaagtcaccaaacatgccatggtacacaggcggcacactccttgaaacactcgatacactccaaccaccaaagcgtccattcgaccgcccactccgtcttccagtccaagatgtctacaagatctctggtatcggtacagttccagttggtcgtgttgaatccggtatcatgaagccaaacatgacagtcgtcttcgcaccatcaacagtcaccaccgaagttaagtccatcgaaatgcaccacacacaactcccagaggccgtcccaggagataacatcggtttcaacgtcaagaacgtcgccgtctctgacatcaagcgtggttacgtcgtcggtgaagctaaccgtgatccaccaatgcaatgcatcaacttcacagcacaaatgatcatctccaaccacccaggcaagatccacgctggataccaaccagttttcgactgccacacagctcacatcgcttgcaagttcgacaagctcgtccaacgtatcgaccgccgtcacggtaagaaggtcacagagaacccagaatggatccaaaaggatgatgctgctgtcgtcgtcgtcgtaccatcaaagccactcgtcgtagaaacattcaaagaatacgctgcattaggaagattcgctgttcgtgatatgaagcaaacagtcgctgttggcgttatccgtgctgtcgaaaagaaggtcgttgaagataagaagaagaagtaaagacaataaatcccaaaccttaattattttttatctatatttttaattagtttaaatctgttcattttgcatacttaattactcagcataaaaagcacatgtaacctaatgaaaaatagttcttaaattcatttcattatgatatggctattggttcatattgtactgaatttagttttccataattttcaaatgatatatgaatttaatgcacttgacctgtaaaataaaactatcgaaattacgaattttgattcacactaaatttatttatgttcctgcatataaacttttcattttaatattttttatgaagtaaatgaactatctttgtataacctttttcagatgcatacataagtgctgtcttaaataatttaaataatatccaaattttatttagaaatataaaattattaaaataaacattaaataaaacaaataaatatctttagcattaacatcaattccttcttgtttaagaagtaatttgacgatttttatatggttacgatcagatgcttttattaaaatagtttgaaataaattgaataatttccaaatataataataaaatatcaaattcttaaaataagttttaaataaaacaaataaatatttttatcattgatatcaattccttcttgttcaagaaggaatttaactatttctatgttgccataccaagatgcccacataattgctgtttcaaataattgaaataattatcatgtatttttttgaaaaataaaattattaaaataaatacaaatcaaaacaaataaatatctttagcgttaatatcaattccttctttctcaagaagtaatttaactgtttctatataaccacgttgagatgctttaataagtgctgtctcaaataatataaatatattttatttgttattatgaaatagcagaaaattaaaagttatattaaaacaaattaataaaaatttttagaattaatatcaattccttcttgttcaagaagtaatttaactatttcagtataatcatttgaagatcatcatcatctggatgcaattgtaagtgctgtatcaaataatttaaataatttccaaatattattttgaaatatcaaattattaaaataaatgtcaaataaaacaaataaatatttttggcattaatatcaactcttttttgttcaagaagtaatttaactatttctgtatgaccttttttaactgcatacataagtgctgtagtaaatacttcaaataaattttgaattttattttgaaatattaaattattattaaaataaatcctagagaaaacatatgaatatttttagagtttatatgtattttctttttttcaagaagtaatttgactatttcgatattaccttttgcagaagcagtcataagtgctgtttcaaatatttgaaataatttccatttattattttgaaatatgaaattattaaaataagcaccaaataaaacaaataaatatctttaatatttatatcaattcctttttttctcagaagtaatttaactatttctatgtaacccatactacatgctattatgatcgcagttgaaaaaaatttaaatagttaccaaatattatttataatcatcaaatcattaaaacaaatatcaaatgcatcaaataaatatctttaccatttatatcagttcttctatgtcttaaaacatattttacaagttcaatatttcttgaatgtgttgaataagctaaagtgttttttggtattttattttcttttaaaaaatatctaacaagatacaaatttccagtccttgcggcttcattaataatacaattatcaacactcattccttcatttttcaagtatgaaaatatttcataattatgatatttaatacatttttctcctaatttcgttattgttttataatcaaaatttataaaattattttcacaaagatacataaaaacatcattttgatgaaatttaatagctatttcacatccatccatcaatgaaacatgattttgctcacataaatgaattatctctaaatttccgcccgcaattgcatatttagctatattttctatatcagaaccatttaaaagcaaatatttaattgatccaaaaaatgctgcgtaactaatcaatgaaatgtatcgtctaataaatgaacatctttcataaggtgatggtacaagaaaataatcaaaatcaaaatcattttgtgttgtcatttcttgaagtttttctacatcatcatttcgaattatttttgcaaattcatttggattttctccttcttcaactaatttcttatgaagctcgggatcattcactttaagatatgtatcgtcattgtcatctgcttctgttttacaatgttcatcaattaatttcatttcaaccattttatctattatgtaatttgacccatatgatttttttgtgttgataagaaagtttgaaaaagttttacttattctggattctatattatgtgttatttcatatatttcaatttctttaataaaatttattattgtacttacttcattttttcttgtaacatatgaagaatatatcattttacttataataaaattgaaagtgaatagataattttcattaaatatttggtcaaaaatagaacttacttcttgaggtaaattttctttgttcaaattaaaaataattttggatgttaattcgagtgctttttgtatatttttttcttgtaattgatttgtctgttttttcatgagaatttattgatattctatgaaatgcaatttataaaaccgtaaataaaatatacaaacaaaatattcaaaatattatatgagataattcatttaaaaatttgctttcaattaaccgttaaattctccgaccaatgcaaatcggatataaagtcggtaacgtgagaaaaaggaacagatttcaattaaatgacgactctacagaaatagaagaagaaaatcaagggatcagtccgaatgaaatagctcaaattgaaccttttctccaacaaattgatcaaaatccaccaaatctcccaataatcttacagttctttgaaagggttacaggattttgtgagataggaatgaaattggtggattcatctctttcttcgtcagtgttatctattctttcaacattttctagtcaacaaaacaatcccaatgaacatccagaaatttttataccttccatgggcattctctacaatcttatatttttcaaatacccaaaagataaactcattacccaaagctttgatcaaattttttacggtatcgcacatgctctagttgctagcccacctaattttgtatgtattaactgttttttttcttttaccgagttatttgcagattccaagatcccgcctaaaattttatttgaattttttgaacccttaatcccgtttatttcactctttcttaccaatcagacacccaaagacactgtttcttgtgcacttcaagcatctttaaccatatctcaacttaatggtcaaaaatcatttcaagaattttgcaaaataaacatagtgccaattttgtttcattatttacgtattgattctgaagcctatgtatccgcttgtaaattattaggatatttatcattaaataatatatttgctaaagaacattttcctgatgattatttagaagtattttcagtcaatcttcaagtcgacaatgaaattcatcaattagaaacaattgaaatgttaagtaaaatgagtacaattgatactcttgctgaagaattcatatccagcaaaatccttaaagtattatttgaattaggtgaaacttcttcatatggagtgcgtgaaaaatcgatggaattcatttgcgatttaatgcaatttaattctcaacaatttgaaaaggctattgttgaatatggtacatttgacttctttattccttttttggaaacggaaaatatcggagttattataaatgccactggtgcaatttccacaatatttaatagactatggtctactggtaaaaaaatggaaatggattcgctaattgaacaatcttcggaaacattgaattacatacaaagctatacagagaataacgaaggagatatcgaagaagcagcaaacttgatcatgggttattatcgtgtttacttagacgaaaaaaatcagggtgaggagatgtaatatgtaagtaaaggttatacaatgaaattaattttttttttttttttttggaaaatgttgaaaaaaatattaaacggattttcatatgagcgaagaaacaatttctccttttaaaaacatgacatcttccgtagaaagcgaaattatactaacacaaggagtgcaaaatgaattagcaaaataccggaaaataaatacagatttacagcttcaaattaattttctaaaaacagaactaagctctgctaaaaaacaaataaataagtatgaattagatgtaagagctaaaaataagttagaaattgaattaactgattcaaaagaaaaaattcaaaatttaatcaatgaaagagaaaaatacaaaaaagaaataagtgaccaaaaacgaaccatcgctgatttgaataagaaattaaccagccatcaatctttacacaaacaagaaattgaaaagttaacaaattcaaaattatctctcaggaaaaagtgtgaaagtttatacactgaattaaatgaatcaaaaaataaattagaatcaatccagaaacttaacattgagcttcttgcaaaacaaaatcaatataaacaaaaatgtaaaaactttgaaaaattacttaatgaatccaatttaaagatcatgtcattaaataaagaacgtagttcttttcttgttaccaatcaaactcttaaagatgaattactttcacttcaactcgaatttgaatcctttaaaataaatcaaaaggaaagccattcaaacaataaaatcattaaacaagacaacaatgatcttaaaagatcaattgaatttttacaatcgcaaattaaattacaacaaaccgaactatcaaaatattcacaagaacgtgaacaacttattaatgcgattggtaattttaatttaattttatataaaacagaagaacaattggccgataaagtcaaagaaaacgaaaggatcaaaaaacgatcaaatttaagtcaatttgttctacaagacaaattcgacatttcgcaaataaaaattccattttcaaatgaaaaattaaataaacaatgtcatgaaataatattaatgaagcaatatgaaccaattcaacgagttcaaatgataataaatcaaacttcaaaattacttgataattataaatcacaagaaaatgtcataaatgaattagaacaaaaaatcacgaaaacgaaagaagaaaataataaaacaaaagaaatattaaatgcaataatttccggccttaaaaatttatcaaaaattaatttggaacttgataacataagtttttgtgataaagatgaagaattccaaaattttattgctaaaaattgttcaagttacatagaatttaatgatccagaaataatacctgttaacatattaataacaagttcacctgaaacccggagaaaagttataaacaaacttgtaaatgatgataatgattcattttgtttatttacaactctttttttaataaaccaacgtttgaatgaaatgaataaaatgttaatgaattcatctgttaaaaagttagaatatgaacgaattgctaaacaaattggagcaaaatcaattgaagaaattccaataataattaaaaacttaatgaataaacttaaaaagattaaagaatcaagaattaaattacgtgaaactatatataataatccaataataaagcaaaatgaaaataaaaaagtaaattatttcgatgaaatattaaaattaaaaaatgaaaatgaaaaatatcgaaatgaaaataataatttacaaaatgaaatcgaaaaattaaatgaaactattactaatttaaaacttaaaaatgtgaaacaatatgtaattaatgatttacaaagtgaggttgaaaagttacaaaataacaataaaaaacttcagaatgaacttgaaaatacaaataaaacattagataatgtaaaatcgaaatattttatgttccaaattcattccaaacaaaataaacttaatgaaaataatttaaaagaacaatttcaacaacttcaaaataaatatgaaaatcttgaaacagaatcaaataaaacaataaaatatctaaaaagacaattaaagaaatatataaatgaaaataaaaataatgaaacaattgacgaaatcagaaataattatgaaaaagttattgataatatgaatcaaaattccgaaacttttaaagaaaaaatcgaatttctttccgattcattaaagaacattgaacaattaaatgaaaaacttaagaaagaaaacgaattaataagaaatatatcaaatgaaaatgaacaaaaaattttaacattacaaaatgtaattgaaagagaaaaacaaaaatttggcgaaaaattagcagcaaaacaaatagaaatagaaaataatcaacataacaaagtcgaaataataaaagaaaaaatgttaaacgaaatgaatatttggaaagaaacaataattaatgaaattggtcaatattatatgttcgataaaaatgatatatccgatgaaacatttaaaaatgttataaatagaataaaagaagatattcataaactacaaattttccaagaaaaactctcattaagtgatcctgaataaaatataaagtgtcgtttatttattttttttatttgttaaaatcaaatttttatatcaatgaaaaaacttttaaaactaaaatttttaatatttaataattcttttgttcgatatgtattcgttagtgtatcgttataaatttttcagataaaaaaattttaaattctttattattttgcagtttgataaaaatgagatttttatttttatcatttaacacattattaataaaaatttggtgaataactgaaagatttttcatggttattcttcaatgaatgatgttatacataaaacaaatgaattagaattagaacacatggaagaaaaacaatttaataatgaaaattataaatcagaaatttctaaatgggaacaatttaaaatatattttaaatttatgatgatgatacgtataaggagtgttagatggtatattttgcttttttttagtatagcttactcaatattagcaggtttgaattcacacaaaggagaaagaaaggaaattgaaaatcctgaagttttatctattaataactcttggaaatttctgaatgaatttataaaattcagggattatcatgtatgttatgcgccactgaatgaaagtattaagaattttacaaatgattttattcctaattattctttgattcgaggttttccaacaagagcaaaaatggaaaattttcttaaagaaaaaaaatataaaggctttggttatacccttacaaaagattattctttcgaactaatttctgacgtttcaagtgttagaagatattttatacatggattttttgattatgttttaacgaaaattaaaaaattaaaaatgaatattaaatatatgggttatgcaagtataattacagataaattcttatcatcatcaatttttgaaattttaataggatttatttttactattgcttcggattctttaatatattattatctaagcaatgaaaaaatattttttatgcttagaatctataatttatcggagctggttaaatttttaacaaatgcatttatttattttattgaagaattaccatgcattataataacaacatacatgacttgttttaaggcaataggatcacaaggtacagatatttctttatatttaattggaattatattacatattattagtataatatgtttaacttttataggacaacaattatgttattttaaagtatcatcaactatatttattatcattcttttatgtttatgtcgccttttcccatttcttttatccttttatgataaaatttcagattcagcttggattcctttaattattttattcccatttgcaggtttctcttattttaatgcattaattttacaggctaagacaagcggattttctctttcatggaattatatttcgtataagttaaatactatctcaactttagaagtattaatttgtatgtttgcaaatacaatattatatataattttaacaatattacttactttaataatatcgcctttatatggaactccattaatctattggagaaaattttttaaaaaggaacaatggaaaagattatttaaaaaagaagaaaataattttcataaatataatgaagtaattcgatttgaacatatatctaaatattatgggaaaacaaaggctcttgacgatgtctctttatatattaactcaggagaagtaattgttacaataggatcaaatggttctgggaaatctacattaattaattctttaatcggaacatttccaacaactaaaggaacaatttatttttgtaatgagccaattaataatgatttttctctcatatatagaaatttgggaattgttttccaagataatattataattaaagaatttactgtttatgaaatgttaaaattatttgattcacttacaggaaaagatgaaaatgaaattgaaaaagatattcaatattattcatcaacacttgaattaaatgaatgtcttaataataaagcagataaaattagtggtggacaaaagagaaaattacaattaattcttgctttacttaaatcgcctaaattattaatttttgatgaactaacaacaggtgttgacgtacaatcaaaacaatttattcaaaagattttagataattttaaagatagtacaattttaatgacaacacattcattcgaagaatctgaaatgttagcttctagaattgttgtgatgcaaaaaggtcatatatcattttgtggtactgctgttgatatgagaaatgaatataattgtggttataatattacaataattgatggagagccaaatatggaaggtgttcttaatgttataagaagtattgttcctgaagcaactttttctagaaataatatgttgacaatttttataccaaatgatttaagagttgctgatgttttggaaaaactagaatcaatgaaaaatgaattagggtttgaaaattatacaatactaattgaaagcttagaagaaataatgcaaaagatcatcgaaaaagatgatttagatatagaatttaaaaataatcagaattctgaataaaaaaaagattattaaatacatattttattcataagaaattttataattgatcaattatattaacacgaatccttttgataagatattattcattgttaaaaataatttgacgacgttcgttttttgtatcgatataaaataaaatcattaaaaagtaaattttcaatagttaaaaaacgttgaaatggaacggtttggcggcaaaaaattttgaagattggagaccaaatgactcaagaaatgcaaatgtgcgtcgaattccgagagacattccaaatgttgtccgattcgttgctgaagttgcaagaaacagatccttccatatctgaaaatgtcaaagagataaaatcaaaaacagaagttattggaaaaagcatattgacatcattgaaatttcaggaaaagcgtaaggctgttagctcttttatcacagatatttcaaaaattcttcatcaaatcaaatctaagtatgaaaatgaacttgactatacaaaatatgactttcttcaaagagctcctgatgggcgctttgttttcgttgtaaaacttaagtcattacacaattctatcaataaggaaaatgaagaaatacttagccaaatcacaaaagacttaactcgtttatcagataaatccatggcaccagccggacttatttcgaagcttcaatcggacattgttaatctttccaataattttggtgtattatatccagatgataagtcatatgacatcattaaagagtatgagaactctattttcaaagcagaattcattatatcaaccaatgagcttgagaaaattgcaaaaaatttcaacattgaatatgaaggattaacagaaacgccaaaagctaaagaagaagaaccagcacctaaacctaaacccaaaccagctgcacctattagtggcttaccaatgggactaccaccatttcaacttggcggaaatccattattatcacaacgaagggcatcaattaactcacctacgactccatttaacagctttacgccaaaagtgaatgcatttcaactaccgaaagctccatttgaaccacataatcaagcaaacaataacaatgaaaatgaaattgcaaaaattaatgaagaaatcaaatcgcaacataaacactttacgaagttaattaataagatgcaaaaagaaatcgatgaattaaaagtagaaaaatcaaattataaatctctttatgatcgtgtagatcgacaatttcttgatttccaagttcaacttgaagatatacgattggtgcaacaaaacattacattcgaattggaggaatttaaacaaagaacagaagaaaaattacaagaaaatatgaacatgacttataaaatacttcaacaaatcgaagcaatgcaaaagaatacaaacactaacaacgaagatacaaacaaaaataatataagcatcaaaaacaatgtaaacagcaaaaacattgaagcatttgaaataaatggaaacatcagaagcttcagaaacaatgaaaacaatgaagatgttggaagtcttcaatgtaacgaagatattggaagtcttcaaagtttcgaagaaattgcaagcattaaaagtattgaggatgttggaagtcttcaaggcaatgaagataatgaaagtcttcaaagtcttgaagatgttggaagtctacaatgcaatgaagatatgggaagtctacaatgcaatgaagatatgggaagtctacaatgcaatgaagatatgggaagtctacaatgcaatgaagatatgggaagccttcaaggtgatgaagatattggaagtcttcggggtgatgaagatgtcggaagtctgcaaagttatgaagacattataagcattaaaagtcttgaagaaattccaaaaaatgataaaaatgatggcagtgaaaattcaaatgttgataaagaataatgatgacaataggctgttggttgtttgaaattctttttcaaagaataaacaatattttcttatttttaatttcgtttcttcgttgagaaaagaagtgaaatcaaattctgagtaaagtattgaaaagtgttaatttaaacgtactcgaaaatacgttttaattttgatggctgattctaacgaggtgcttgcaagatcaaatgaacttttagctcgtgtcagacagcaaatcaatgaagggccaacattcctaagagaattagcacaacctcaaagaactccagtatctgtgccatttatgccaaacacaatttcacttgatgaatcatttcgttcaacgcaagatatcaatgaaagtcgtccacaaccatctcaaccacaaaatgaatctacaacaatgaatgcagaaactgtcaatcgacttaaagatttattccgccgtcaaatgtcacaactacaatcaccattaaccaaaaatgtagctgcagaacaagaatccaacaaaagtgaatcatccaatgatcttgatgaagaaatatctcaactagagcttgaagatgaacccaaatttattgaaccacaacctattcttgatcaaccatttgttataattaatcgtaaaaccacaactaatgaaccagatcagccacttttatctcaagcaaatgttgcatatccattacaaaacgatgatgttccacttgtatcaggttctgacattgctgaggatggtttatgggtcccagatttaccattatgcaaaccagaaaatgttcgtcgattagaatatcgacttttatgggatgatcctcgtcgagaattttattttggggccgactatgggatgaaagttgatacgccaccattaacgcaaatcccaccaccatttccattagagcccattacacatcgtgggtatgaagacataaattatgctcctgctagtgtctgggggatagaagacgtcgatatcacgcgttcatttaagatcgaagtgacaaatgttcaattctttgttcatcctctatcgtcctctgaagacattctctcaatgaaaatccgacagctatacacagcttatgtcaaagaccaagagttatcacgagtacattattacaaagatcgaattcaagcaattcgaaaagcgctcaacaccgaagagaacaccgagaaacaatacgaatattacaaacaactcaaagaagcacgcgaaatgcgcgacatggaagagcataactcacgcatgattcgcgagtcattaatccaagcgtggcaagagctaaaaaagatacgaacgaacaattcgtttacatcgacatcgttatcattaaaatggcaaagtcggaaatattcggaagaagagaaacaactcgaagaaaaagcatttgaagaagacttaaaacgaaggacacaagaagaaatgaaactagctgaattcgaagggaaaaaacttaattcagatgaagtcatgaaacaacttcatgatcgacatgtcgaattaggattacgaatgccaggcgattcacaatggaaaccaattctatcaaataatgccgaagttacaccattcgaagaatgtactaaagaagaacaagaaagaagacaaacgataacagaagcgaagatatatatcaaaatattcattaacaatgatgagacaacaaaaactaatgaatatccattagactcaacattccgttgtgactttaaagcaggaacacaatttaaaacaacagtaataccacaaaagatatcattacaattatgggaaactggttatattaagcgtccacgttatatatcgacaattgtattaccaataactataggtacaaatccggaatttaattcatttgaatttacttccgattttacaaatgatgaaggtcaacttataatgggcactattaacgcaagatgtttcatcgagcctgatcctaacacggaattattcttaagatgtcctgatgtacaagtccaaaagactaaaagaagattagcagcagacccttcatcatttatgtcagtaccatatttacttaaatatatcgatagtcatgacccaaatgatccttatacaactgcaatgacaacatcgatattagcacaaagaaatgctgaaagagttgtcgggaagtttcgattagattcacagattaatgcaacgacatttgaatctttagtaccgacaacagttggaatgcaattacaaaatcgtattaaaaaactccaagaaatggatgagaaacaaatgcaaaagaagaaagagaaaccaaaagatttcatcgagaaattaaaagaaaatgaacttgtacaaagtactactgtatcaacgaatgtacaattaagtgacgtagtacgtgaagcaccaatgccaactgtaccagcagtgtttacattctttaagaacattataggtatgtatcgaccattaaaaccaattcgaatacaaagaactacttcaactaaaatcgaggcttattcgaaattagtgattagaatagttcgagcaatgaatattccagaaagaacaaaattaggtactggacctggtactgtttcttcattaatatattcttcaacaaaagattcaaatacaaatatatattgtaaagttacatacttaaaacaaagtaaaaaaacgagagtcgtacaagggaaaaatgcagaatggaaccaaagcttcgaattcccaatatcaaatgatcaagatcaagtgccaaatcttgaagatgtagcaaagctaaatttaagaatagacttattcgacgaaatttcattccaagttatatcagatgatagagaagaacaaatgaaacatgaactaattgagccacgtttcttagggtctttagtaataccaattagtagtatttgggcaactggtattatcgatggaattgtgtcaattaatgagccttgtttccaattaggatattctaagcctgaagatccgtttagaatgtcattatatttgacattagatccaccaataattattccagattttgtgggggatttaggaagtggcgaaaatgaggctgtgatacttagggctaaaaattggttgattaagatgaatgaaatgaaatttaagaagaaaagaagaattattttgatggcttatccaaaaaatgctaaacctattatagcttgtaggatggtaaggaaacaaaaccctcctgatggatttaatactcctttacaattattaagattcgtttcgatgattccaaatgcttctgacgcggaggttttcaacacaattaatgatgtgtggtttacatcagggcagtttttatcgttgaacgctggcgacgaagaagaacacgcgttacttttatgtaatacattcaaaagcatcggtttggattcttatgttgctttaggttatgatttaattaatggaaaacatgcttttgttataacaaaagaatcaggtagaattactttatgggatcctataatgggacgttgttggaattcaaaagatagattttgttcattttataatatcggtataatatttaacgaagaaaatgtttgggctaatatacaaagtgacgtagaaccatataaggttgattggaatattcataataataagttatggtatccattcttttcatcagattttaaaatgcctcctttagattctcctcaagaagatcatttagagtataaacaaaccgatgactctttagctagaagaactgaaagagaacttgataatgcaattaaaagtgctgttgaaagatggagagaacatcaaagaacaagttggaatcctcaatttgcagaaaagttaagaagcgcattggaaacttgtgaaagagctgctttaaatgatccaaatactaattatcaaacaattattgataatttggcatcacaatatacatcatatagaatgaatggaggcccattttgtatgacttttacaactattgatgacgtaattaatgaagtatcgcttcaggaagtttggaaaactgaatcaccatctacagatttcgctttaggtgtttatgtcgtgccttatccaaatggaattttagttgtgtgggtaatattggcgtgtttgcaatatatccaagaagcacatcctcctttgtagttatatgtttgttttgtttttatgtattttatataaactgaatatgttattaattttgttctttaattattttcaagaaaaattgctaatgaataagtaaatttcgcttttttttttaaatatgaaaaatgatggcgaacgtttaatagtaaacgttcataaccgatagaggagatacacattggaaatgaagcattctttccaaattgctgttataggagctagatatacaggcaaaacatcaatcattggaagatatgtcagtggatctttttctaattatacattcacttctccaatcccaacagaatcaaaagtttcaattcgtttaccaaataaacaaacagttgaacttcaaatttgggatatctctggatctgaagatgcaaaaatgatatcgataccatgcgttcaaaattcaaatgcagtaatctttgtttcttcttatgatgttgaagattctgtttcttgtgtaaaatcaacatggcttcctgttgtacaagaatctcgtaataatgcggttatgtgtgttattaacaaatcagatattaaaaatacagaaaaaagtaaacttagtgatgaagttgtgcaagaacttaaagaagaatttggaggttcgtttatagaaacatctgctttaaacggtaatggaattgatcaattattcaaatcgatcacagaaaaatatttccaagttaaaactgtaacaaagaataaaacccccggtaatacaagcgaaactaaagaagaaaaggataagtgttttattcaatgaaaaaatttcaatttaaaattgtcaaaaataaagaaattaatatttaattgttttatgaataattttgtaagcatttcatcaaaattacattttcgttttgtcttcatcatgtatatcgtttcaaattaataattatttattcatttctcaatttttatttatttaaataatcattattgatatcaatttctggcgaataaataatcattcaaataatagtttatagttaagtacctcatctaaaattagatggagaccaaaacatataaaacaaataacataaattatgcaataagagaaacaacttaaatttcttaatgaattcatatgcaaagtgatgatatttttataatttattcaagtttattactaagaagaacatcaattttcccgaccagtctagaagcacgtttctgaacttctaactcatttcttatagtattgacgagtttatcaaacaatgacccaactcttggattatcgctaattaccaatctgtaaattttttcaacagatgcaactgtctttaagataatttgcgaccacgcaggattggttacgttttcggtaaggaactttaacaaaggcataagtcgtccaggatctcgattcgaaattgcttgatctaatcttccaagtctgtcaagttcatcaagcataccaataatgattgaggtatcgccaatttctagaacagagtctaatgcaacttcttcattaaatctttttaattcacgattgtatggcgcatcattccttggttcgtattgatttaaaactctgaaatttgctggcattgaaagctctggattcttttcttccacaatttcttcatcttttgcaaacttaagttgaacgaccccccctgataaaccgatagcaaccgctgaagcgtcacttttggcatcgaaggcggttatgtcgctatggagtttcatttggaaaagaagagaaaacgaagatggatcaaaaactttgattgttctgtctcctgatgctgtaacaaggttggagcgaacaattgtcattccaacaattggtctggtatgtgcaacaaattttgaaactaatgtagcttttgctttaatatcaactacaataacacattcgcctgaagaagcaaaagctcggtttccacaaagtgtgatatgagtaattggataatttggatcgacaatttcagataggcattctttctttgagaagtcccatatctttatggcaccatcgtgtgaagatgttacccaaatgtttcctgattcaagtggaaccacacccgaaacagcatcattgtgggcttggataacttcaatttctttcctttgagaaatatcaatgatatgaacttgaccatttcctgttcctgcaataatttcattagcaaatggtgaaaatgatagagaaaagacaacaccagaatttaatttgaatctttttagaagagtttgatggtcttccgttgggtatatatcaactgtcccatcctctcttcctaatgcaattaaaatcccatcttttcgaaatgcgactgaagtaaatggtgtttttgtttttgcaaatgagaatttatgttgatgtgtccttccatcaatccaaggaccagataagccagaaagggctacaattgaatatggagcaacaggcgaaaatttaatttgatttattgcagaattaaattgaaaaatttcgttttctttgagcttctgccagacggtagactcttcgatttctgttttagttcggatttctccaactgaaaatggaacagctccatatttttggaaaaccttcattttgtatgaccattggattcaaacaaagcaattcaattattataagaaaaccgttggggcaccctgtttggaacaaaaataaaaatttcttgttttacatttcaaagagaataacttgttaagatgttcattgtttacttttgtggttgttcgggtggctttggaagattcaatgcccaaattctttgagctttatgggatgtaacaaagtcgaaaagtacaatgttgattggtgaaagttctcctggcttatcttcgcaaatgtaaccaagtgatcttggaatttcgaagttgaacataccaaattgatcagaatgaatgcattgatcgagttggtatgtaaggcgctgaacgctatggcctttatctgtagccttaaggtattgacctgtagcagtgaaataatgaagattaaatgtatttggtttaagagcatctttacctttttgcttggaaataatacgagcatcacggaagttagcgagaatcttttgtgggttatcgctgtttgagtaatttccagaacaatattctctgaatgggaagaatttgttattactaattcttgaattaattttagaatctgcttttggtacatcaataaagattatgactggatggctaagatcaatatcattaggattgattaaatgatcataagttaatgttgatatttggataggatttttcggatcttgatcaaaaattcttgaacctagcatttgacgagccataaaacaaacagagctaatgagttctttttcacattttatcttgaccataacaatttctcctgggtgaccatcaacgaacaaacggatcatatcaagatctgtttccaaggaatttccgataacggcaagaactcctttaccatgatgaatcataggaacaccatcactttccatacatcttaaatcaaagtatctaacaccaagcttcaattgctcagtgatggaaaagtcttgtgtttgataccagttgtgaccatccatttcataagttccagaatcatgagttcctgggattttgatacgattaagaggggttgcgccaaaggttggaccaaatccaggcatagcacggatttgttccatccattttgaagccttaatgttccttctgagtaaggaggtttgcatttggggaaatgactggttttaacgtaatttgctatcgctttttcaatagaattttttgttctttctgggttaaaaggcggttggactgaaatttgaaataaactgctcatattctaaaataacgttcactgaaaaatgctttccttcgtttttttatagtgtggaaatgattctaacccttttctcactataaataatgaataacagttttgcattaaataaaccaaaaagatcatgttttttagcatttaaatattgaaaaaacaaattttttatttgagagatcttgttttttttttgtgtactctacataatttttgaatgatttatccaaaccatttcaattcaaccttcacaaacccaaaatatgtccaaaaagaaacacatcaataaataaacgaaacccaatgattaaaaatgaatgatgtgtgtgataagctaaaatcgataacatataaattaattaagaaattataaaaaaaaaatttattacgaaatattatcattttattttctaaatttaaaacctatattcatcatgcatcaagcataaatggttaattatattctctaatctaaaattttattcatgaatttttgatttcaaaaagaatacatataaaaataaatcgaaaattaaatatatcatgtaactataaaaaaggtaatacagagattttccaactttgttgtttaaggtaaaattagagtgcatgtatgttgttgcgcgaaattgaattttaatttaaataggtacctcatgccggatggcgaccgtttgcgagacatataaattatcgtttttcattcaatttttatgatttcgtccttcgacaaaactgatcgaattccttgctccaattcgtccaatgttaaatttggaacacctttttgatccaaaatactcctaaactctctaagtgtccattcttttggtgagtttgatcttccatttatttgccattgatttgttgtcctgttgtattgtatatccacaatacactcatccatagaaagaatatttggctttgcaactccaaactcaacaacttctttatcagacccatagttatccacagtacctacacaaaccattgtttctctcgagactttaagcttaacagcaggataataagagttgcttagtttgaactcaaagatatgagatggattttgacttccaatttctgatttctcatcttttggatagaacaaaattcctgaaattggataatctacaactccttgatccttttgaacaaatttttcaaatgaagttaatggaaaacttttgaacacatcaattgatatcatatttgaaaagatatcattggaatatttctttgtgcaactgacaacatgggttgcaactgacaatctttcatatccaggcttttggcgaatatcattatcaaaataaattaataaatctgagattacaaataacggtttctgtcctggaattgaaaccaaataaccttcaaaaagtgacatgctaaccgccttttcaggtgacatgtcaccatacaactttaattcaattttttgacatttgtttttctcttgaattagatagttaccatcttctgcgatgtaaagaagacatctaattccatgtggcttaggggtcaagcaatattcactcgtcataagttcaaatgatgatggagtaagtcttgaaattggtgtcattggtgttgttgctctaaattgctgaaactttacattaagtgacataataagtttggaacgtaaacgtgaatcaacaggttcgccaatttcatcaaatgttattcttacaccagacttttcctcttgtgaagaaactattggaatttttggactcactacttgtggaggagctattggggattctggttgggaatacattgttggtgaaaaaacttttggctgtggtaagggagaaaccactggaatctttgggcgtgtatcttttgttggtgtttgtttgtttggtgatttctgttgtggtgatgttgatggtattgggatgtttgatgtatcttgttccttaatgaagtttgaattcttggtatagagatactttttattgatttcttctacaatatttgggttcgttattccattgggaaatgaattagaaaatgcagaaaatgcattattgattgtataagattgttcttcaacaagccagcgtacaattaaataaccacatacatccatgccattggtagatacaaggataatggaatcatttatattattttgatgtttaatgtaaaattccgctactttttctttgaacaaaaaaaatgttgagccggttggaagctttgatggtgatattttaaaaaattttattttaaattcttgcattgcccttttatcaatcgttagatatctagtgtgataaaatatgaaaattgttgaatttttcttatcctctattgtatcagatatagctttaaagtcaaattcatagccctgatcaaaagcgtaaggtatgaagcgtaagactttctttccggaaagcaagtgaaaaatatcaaacaaagtcgcaagaaatctttgtgaatttcagggtgccccgtattattgaaaaagttcaaaacctaatttaggagataaaagttttatcaaaacttgaagtgggaatgaaaaacaaatatatgttttaaatcatataaaatatacctagcgttaatgacaaatctgaagcaaatataatcgttttgcaacatggaacaatatctatccaatcactaccgatttgttaataaacatattaatgttcggatttatataatttgagaaattaaattatatgttgtagagcagaaaaattagactatctattatatatgtatataatatatttgtgtagtcaacatattaaaagtagagtaaaaataatgttgtgcataaaattttttttgtatcaaaaattgcagaaattcacttttgcttagtttacttccttttccgttagaaggttctctaaattgataaaaacaagtgcaaaaaaacaaaataaattaaatgacatacataccaacatgatgtatagatgaatataaaagataaaatattttattaaatgaataatattttttttaaatcttcaaattgcgaatcactcacatcatttgatttattcattaaattcaatgaatatgattagtttgatatgttgtttatttctttcttgtttatatctaaacttatattcattattttgatcgaaaatcatttcttcataacaatttaatggttgaaaactttctttactgatttgtttgtctttagttttatcctactttaaaagaaaatgatttcatttgcaaatgagctcatttgaagaaaaacgatataaaatcccaagattgccacttcaattcaaatgatataaccgttgaaacgagccttttcaatgtaattttctccgttaattcaaattaaaaaccaccggaaaaatcaacaataaaagtggacatcaacttcaattttgtgattttaaacaatatttttaaaaattctaatccattaatctctcatgtaaaaaaatttgatgaataacatatgggtatttcgaacaaaaactttaatgatgaaaatgtattggttaaaacctcagtttccttgtataaaaattctctcaaaattcaaaacttcgaccaaaattgacttgaatcccagcggttacatagaaatcaagatttttgaatactcgtttacttaaaatggaatacggaagctcgaatcaaggttctggagaatacggagaaaaattcaaacacgacccaagtttcgatggcgtagatcgcgagagaaaatgtacagatatttgcatgtgcatcttctttttcttattcatctgcggcatgattgcaatcctagtcgtttcagccgttaaaggtgatccaaagtacttctttgtaccaactgatcacagaggtcttatgtgcggatataacaaccaattattgaacgtcgaaaacgcttctgatttacccgatttaacagataaaccagcacttttctgggtacgtcctggtgtaaaaggttacgctagaagcttttgcgttgcagaatgtccaaatgaaggtctttatacatatgctttcaaagcaaacctacaaatgcagtctaaaaaataccacggatacaatgcagatgatatgggtgtttgcgccaaatggaatgctacaacaaattcaacaacaccaattgccccagcaattgaaaactattcaacaacagatcctgatagatatttctgtggttatgcaactgaagaacatttcagcagatgtcttccagttacagctgcctttgatgatatcagaggtgatgttactcaaacaatgaactatcttgccaatgtttcacaatcaattgattcagtatcagctgttgtacgtgcaatccaagatctttacaatacatattggatcattgcagtttgtgttgttattgccttagttctttcattagtttggctcttcttattgagatgctgcgctgctgtctttgtctggatcacagttgttcttaccgctgcagcacttgcgttccttacatacatgtgttaccatcaatccaagaacaacttcgacaatgctcaacttattgcaggcattacacttggaatttattccgaagaactcaatcgcaaagtattcaatgtcttcttctacatcttacttgttcttgacattatctttgttcttgttttactcttcatgattaagcgtattgtatatagcatcaatgttatcaagacagtctcacagatgttctatagtgtcccatcattattcttcttcccgattgcacaatacatcatcttattcgtatggtggatttatgtcattgcagttgctattgtgttattcggtgcaggtaccccaacacgtggcattgttcaattagattcaagcgatccaatctcaacagccgatgtaatctcaatgcaatatgatacagttatccaaggcttctccatctatcacttcattggcttcctttgggtttcatgcttcattatggcattaggtgagatgacagttgcaggtgttgttgcagaatattactttgcttctgatgacgaaagaaacaacatgcccaagttcatttgcacacgaagcttacttaggtcacttcgttatcacacaggtacacttgcagtcggttcactcatcataacaatttgcaagatcattcgtgcaatcatccaattcattgaacaaaagacaagagaatcacaaaacacagcagttaaatgcattgttaaatgtcttaagtgctgcttctgctgcctcgagaaattcttgaagtatcttaatagaaatgcatacatcatgacagcaatgcacggatttagcttcttcaaggcatccaaggaagcattcttcttattacttagaaatgctgcacgtgctacagcacttaattgggttggcgacttcacattattccttggccgtatcctcatctctgcactcgtctctggtatatcaatcctcatattcaaggatcaagatgacgttacattctatatcgtcccagcagtcattgttcttattatgtcttacttagcaagtggcgctttcactggcgtgttcgaaatgagtatcgacgcaacattcctttgcttccttgaagatgaagaacgtaacgatggcggtcctggtgctcgtcgtcatactccagatgaaatgaagcaatatcttaatgacaataatttaaatgcataaattaaggaataattctaattaaactattaatggtttgaaatttgaacttaatgtagaaaaagtgtctgttgagtttttgacagaaaagtggcggccactttgagatgcatctaacgttccccggtgagaaataatgagaatgggaacgaactgttacttttgtgcgtttttgggagtaactcttgttaactattaagcagaagctgcaaattagcaaatgggttaaggtgtagaaataatttgaatcgcataaatgctgaaggaaatttgttgtgtataatataattgtcactttttgcatactgaaggttttggagtcagatggagaacgagaaagcagaaagtgaaagtgttcatttgcgttggttcaagtttaattttttaatttagcgtttgtttgtaggttttaaaactccattgcaaatagcaatatctgaaggaaattatcaaaatgttttaaatcttcttgaaaatggagcagatacatcacagatattggataagaaaattttgccaccaatacacttggcaataaaacataaacagacggatattttaaaattactacttaattttaaggcaaatccaaatcttccaacatcaaatggagttgttcctttaatcacagctatcaatagtggaaatgatgaggcagtttcgattcttcttcaatatggtgctgatccaaatactgttaattctatttatttatataacaaaaagtttatatatctaatttggagtttatttttattttttgaaattcctctttttcatgcgattcatgtaaagaatactaagtcgataaatcttctacttaaatcaggatcccaacttaccattggtgaaaagagtgctcttcattttgctgttcgtatgaacgatccagaatgttgtcgtctcctaatgtattatgcagatcttaatctaaaagatcaaaaaggtagaactgctttggatattgctgcttctatggcagatgaccctacctgtgagctcctccttggttgtaatccaatcccatcaacaactaaaggcgttcaatttgctcaagaagtatccgaccaaatagaaaatgaaaaagctgcacttttagccgattgggaaattaggatccattcaagtggacaacattatttacaatttttagatgatgttattcgtgtaacacgtcgtcttaatcgtttttatcaactcgttgctttgagagttagaatgtatgaaagaagattgaaacaatttgaaaagaagatgagtgtaaatgaaggagatcctgatattaatgcactttctaaaatccttctttcaacatggacaaagagaattcaagagtcaaaggatttacaaaagaaattattaccacagatgtattctgcaaatggaaatgaagcactacaaacctggagcgatgcaacaaagaaaagagaacagtttatgaaagaactcttgctaatggcaaacaaagaatcaaaaggattcattgaagtaatggcagaatctggtgacttatccacattaaagaacatgcaaggaaagaagagagtggaacaattccaacgaaaaatagcagagttgtgtgataaagaaataacagatccagaagtaacaaaaagaatagaagtacttaaccagctcgctggcataagagcgtccaaatgaaataaacaaaacgtgtagaaagttcaaaaggccatcatttttggagttattaaacaattgtctttaattgtcactttttaataagttggtgctgttttgacaaggtttgtctggctgtgccttttcatcaatgagcattccaactggtgacgaaaagaaggaagttcttgcaacacaagcacaacagcgtatccgccttacaatcacatcatcaaagctcccaaatctccaaaaagtttgcaataacctcactcaaaaacttaaggccgaacatttaaaggttcgtggaccaattccaatgccacgccgtcgccttaggatcacaactcgtagggctccatgcggtaatggtactgaaacatacgatcatttagaacttcgtatttacaaacgtgttattgattttgttggtacaccagcagctgttaaacaagtaacacaaattggtctcgaaccagaagttcacgtcgaagtttccgtaataacagaataaacgaattcttaacaattaaatttaaaaactttttacaaatgtacaatctcactcaaaggcatttttttcaacaagttttgattctgttttatttcattgatttggcttttgaccaattccacagacagagcaattgacattcttctcacgaagcttaaatctcctcattttcaacttgaacatgtctatggtcaacagctcacgtactagtttgtcgcctactccggttatgattgcaattgcttgttgtgcttgtaaagttccaacaattgaacatattcctggaacgactggaggtggcgatggcaattgttgtggaacctgtgggtgaatacatgaaaaacatggacattcaggatctgattccaaatcacaataaacagaaacttgaccttgacctgctgtaatagagccaaaaaccatgggaactgaagctctggcacatgcatggttaactgcatatctaacttcaaagttatcagtacaatccattacaacatttggatgatgttcttcgattaattgataagctgtatctttatcaatgtgagtaataactggaacgttatctgataaacaaagaagtggtgatgaagctgctgttttggattttgatttaccaatatcattttgtgtatataaaaattgacgatgaatattagatatagatacttcgtcacaatcaataagaataagatgaccaacaccagaacgagaaagaatagttgaacatgtgcttcctaatccaccacatcctacaatcatgactgttgcatctttgagcttagcttgaccttcaaccccataaacagggagctggcgagaaaatattgtttccaaatcgctttccatttaaaaatggaattcgttgattgcaatccgtgtgttcgaggtgccccatttgcacgaaaaaacgtttgtgtcctgttcatctgtacattgagaaatccatgtaatcaatttcttcataagtttgtccttttttgagtacaacgctaagtacatgcattttcgtccttttctatttgaaaagcttttaaccgaatttatattgaacattattctttgtatatttaataaatattgtttgggataagctttacatagtctattccttgctattacaagaagggttaactgtatggatcaatactgatatatcagtaactattaatatttacaaaaataattattaactcgaataaccaaaaatattcaacttattggaagcaaattactgaaaattccaaaccaaattaattctttttgtatagaagaaaaagaaaaataattgtaatattattaatgacagtatgaataaatatataaacaattgcttttcttgtaacatactacattttttaaattaaagacattttttcatttataatttggtaatcatgagcttaaatcagcaaaaaacgtcgaataaaacaaaggatcaactttttgaatttattttgcggttgtatgattattgcaagaacaaccttcattttgatcaaaacaacagttttatggtgaattagcaatttatggcaccacaaattatttttggtcagtatcaagattctttagctttaacctaatagatagctcaaacgattgtttaaaataatttaaaattattaaaactgtattttcagtttcttgaaattaaacaaaaaaattgttcatggttggtttttccaaacaatatgaatcatgaatgaaaacaatgaatttacttttaaaaaatattccttcatagtataactgtttattttgtgttattagatttcgggttttatttggttttactctttttctcaagaaataattttacgatttctgtgtaaccatttacagatgcaattgtaggcgctgcataaaataatttaattaatctccatgtattattttggaacaaaaaataatcaaaatttttatcaaatcaaatctataaatatctttaacattaatatcaattcttttttgttcaagaagtaatttaactatttccgtccgatgatttctagttgctaaattaagtgccgttataaataatttaaataatttccaaatattattttgaaatattaaattattaaaataaattttaaataaaacaaataaatatctttagcattaatatcaattccttcttgttcaagaagtaatttaactatttctatatgacctttccaagatgccaaaataagtgctgtattaaacaatttaagtaatttccaaatattattttgaaataccaaaatattaaaataaattttaaataaaataaaaaaatacctttagcattaatatcaattcctttttgttcaagaaataatttaactatttctatatgtccatttgaagatgccaaaataagtgctgtattaaacaatttaagtaatttccaaatattattttgaaatatcaaattattaaaataaatattaaataaaacaaataaatatttttctcattaacattaattctttttcgttcaagaattaatttaactatttctgtatgacctttttgagatgcatacataagtggtgtataaaataatttaaataattaccaaattttattttgaaataccaaaatattaaaataaattttaaataaaacaaataaatatctttagcattaatatcaattcctttttgttcaagaagtaatttaactatttctgtatgacctttccaagatgcataaataagtgctgtatcaaataatttgaataattccagaatatcattttgatatataaaattattaaaataaattttaaataaagcaaataaaaatttttagcattaatatcaattcctttttgttcaagaagtaatttaactgtttctattttaccattttcagacgctttcataagtggagttttaaataatttaaataatttccaaattttattttgaaataccaaaatattaaaataaattttaaataaaacaaataaatatttttctcattaacattaattctttttcgttcaagaattaatttaactatttctgtatgaccttctgaagatgcttcaataaatgatgtttcaaataatttaaataatttccaaatattattatgaaatataaaattattaaaataaatccaaaataaaacaaataaatatctttagcattaatatcaattcctttttgttcaagaagtaatttaactatttctgtataaccttttatagatgctttcacaagtgctgttttaaataatttgaataatttccaaatattattttgaaattctaaattattaaaatatatattaaataaaacaaataaatatttttagcattaatattgattccttcttgttcaagaagtaatttaactatttctttgtaaccatttcgagatgcataaataagtgctgttcgaaataatttaaataatttccaaaaaatattttgaaatataaaattatcaaaataaattttaaataaaacaaataaatatctttagcattaacatcaattcctttttgttctaaaatgtattttataagttcaatgttttctgactttgtagaaaaaagaattatattttttgggatttgattttttgataggaaatattttatcagatataaatttccaattttagctgttttattcattattaaatcatttattttcattccattttgatataaaaataaaaaaatttcatagttggaatattttaaacatatctttcctaattcttccaatgtttttatttcttctaatttattttcataaagaaatttaaaaatgttattttgatgaaattcaattgctgttttatatgcattttgaaaagatgaatgattttgttcacataaatgaatgatttcttcatttccacctgcaactgcatatttacctgtgttatttacttttgcaccattcataagtaaatatttaaaacatttaattgatccaaaaaatgctgcataatcattaatgtaacatttttatgattaataaatgaacatctttcataaagtgatggttcaattgtttgatcaaaatcaaaatttgtttgtgatgttatttcttgaagtttttcgatttcatcatttcgaattatttttgagatttcatttggattatgcccttccttaattaactgcttatcaagtccataatcatcttttgaaaaattttcatttgatttacccatgaaataatcaaagaagtgatatgttgtcctatattttgtggttttaccatatttaagatactttggatcaattaaattttttttaatcattttcatctttaaataacatgattcttgtgtattaaatttaactaaataatttctaaatattttaataatgtttgggttatatttattgatttcttcttctttgagtttaatattctctaaaaagtttatataaatataatttaattctttctttgaataaaatgcataataaactaaattacaaattatcaaattaaatgaatatggaaaatttagatcaaataatttcattgtttgttcaattgatatttcaaaattttcttgtgttaaattaaatataatttgtttgagttttataaatttttttacaataacagaaaatttgctttttcttgttttcctgtgtgatttatgcctttctttctgcaagcagggatgaaataattttttgacatcttttattaacattacaaaaagtgttaaataattatgctatcgtcctctttttttctttaaaaaaagctagcttaacagatcccttaccaagtttgaatttgaaatcaatataacaaaaatatggaaaaaatgaattttctttgatgttaaacgttgtcattttttttttgatgattctacaattttcttataacataaaaagttttgcatttgaaaaaattaataaaccaaaaaattaattattttataaactatggtaaaatcaaaaatgaattttatgtttatttttgtactggtgacttcgttcttttatgaaagaaaaaaaatatttaaacgtattcaaggccccctaattaatgtccttactaaaattttttgctcctgactctcaagaaacagatgaagagtttgtcaatcgatgtttggacaacctaaacaaccctaagttagttcgagatgcacttatagatattgttccatttgcacgaaaatattcttcaataattggtctaaagtcaagcacgattctagctaagcttctatcagattttagtaaagataacgaagcagtacaaaatattttacaaatcttgaatgaacttgttcttgatgatagtcttgattccaattctaattctggttatattgttgatgaagaaactgcacttcctaatatttttgaatgtcttaacaataagtctgcaaaaatcagaggattatctctgagtcttatcaaaaatttattacgacttcaaccatcaaaagtacaatcattctttttcgagactgctcgagcacagaaatccctttgcaatcttattgatgatccagttgatatgattcgctctaatttcatgtatcttattccatcgttagttcaaggcaataatgacattcaacaaatgatggcattttctcttatggatccacttgcagaacgtatttccactcttccatctgctgaagtgattccagcacttcaatcattgcttgatggtaattctaaagttcaaaaattatttgtagaaacgggacatttaactaaactcttaccacttataaaatcacgagatgacagagcaatttcacttttaacaatgttgtttcaatcaacagatgcagcatcatttcgaccgtttattttggacagcggtttaattccaccgttaattaacggtatcatgaatcatagcacaaattcgaaaacacttttaaaacttttaggatatataattcgagggagtacagagttatgtttatccatatcaaatgaacttgaaaaaatcatcacgttaacaataacaactaaagataatgaagaacaaaattgcggactatttttcattgaatgttattgtattaaaggatcaaaatcagtttccgaagcattatgtaatcataactcattatcaaatatattacagaacttcaatgaaatgataacagagaattatgcgatttataacattgcatgttcatgtttaataacaaataatgaaacgaaaaacattttttatgttaataatttgaacaatgacaaaagtttctttatgtattcaattgaaacattatcaaagattactaacaataattcgattgtattacccgtaatattaaaattcatttctgcgataatttgggaatcttcaacagctacaaaattgttcatatcaacgatttcatcattacaaaggaaagataaacaatcaacgattatatttttaatatctttatgtattgatgaaactaaagaacctttgctaaagagtattacaagtttaatattacttgaatcattattatttaagactaatgatgaagtatttatacaattaatcgaattaattaaagcacgtataggaatatcagttttgattacatcgataaataattatgtcgattctttagaagaacaatcaatttggtatgattttgttcaagatgttgttcgagttgtccgtaaaaacagagaaaatcttttagatattaaatccgaaatacaaaacgattcaacttttcaagcacaaatattaaacttaactgaaaaaaatgacgaattaacaaaacaaaatattgaacttaataagaaaatcgaagaaaataaagtgacaattgaatcacttgaacaacaaattgaagaaattcaaactgttataccgacatatgaaaaatgtttaaatgatcaacaacaaactatagctcaaacgaatgaagaaaaagaacttttaaatcaagaaatcgaaaaattaaaatcaaaactttataatactaataatatattattaggcaatgatgatgatgatttacaagttaaatataatgatttattaaaacaatttaatgaaacaaaagaaaatttattaaatcaaataaaaaacttaaaagaagaaaatcaacaattaaaagataaattactttcatcaaatgtaactaatcaattagttaaagaaaatgatgacttaagacaacaaattgataaagctaaaaagcatattaaagatttagaacaagttgatcaagaattacaaaactctaaaaaagaaatagaaaaattattaaaagataaaattgaacttgaacaaaaattaaataacagtaatcaatcaaatgataatgaaaaagtttcagatttattattacaaatacaaaacaacaaaaaagttattgaaaatttacaaaatgaactttcaaataaaaacaaaaataattcgacaaatgaattaatcgaaaaggaattaaatgaaattaaaattagaaatcaagaaaaagaattagatttaaataatgaaataaataaattaaaacaagaattaaatgaaattaaaaagtcaaaagaattcgattctgaaaatttcacaaatgaattaactcgaattcaacaaatgaatacagaaacagaaaatgaacttgttaatgctatggatgaaaatgaaaaacttataaataaattaaaatcaaaaaaggaaaaaattcaaaaacttaaatgtaatattaaaaatatttcatcaaatgaaaatacttttaatgaaaatgaaacattaaataagttaaaagaacaattaatagaatatcaattacaaaataaaaattatattaaagaaaatgaaacattaaatttcgaagttaataaaacacaaaaagaaatcaaagatttaattgatcaaaacaagaaattgaattccgaaataaagaatttcgatgaagaaaaagagaaaattataaaggaaaaaaatgaacaaattattaaattacaagaaatatctgaaaatcaacaaaataatatcgaaaagttgactaaaatgatcgataattcaaacaatgaattacaaaaaagtaaaaacttaattcatgagttacaacaaaatgataataaaaaagaagatttaaataatcaaataaattcatcaaaagatttaattaaaaaactcgagttaaaaattaatgaacaaaaagaagaaattaaaaatttacaaaataaagtttcaaatgataataaaaatgaaaaaatatcaaaacttgaagcacaaataaagcaacaaaataaagaaatagaaatacagaaagaacttttaaataaaacaaagcaaaagaatcaaaaactaaaaacagaaatattaaatcttcaagtaaattcaaataaagacaacgatttcgacaaaataattaaagaaaaagataatcaaattaacaaattggaacagaagtgccaaaaactaaaagcaaaaacattaaatattttatcagttgaagcgaattctaacaaagacaacaacaaatcagaaatacaaatgaaatcaatcaaaactgataacggaataaaatcgaatttaattattctcgagcaacaaatagcaaaaatcaaaggttcgattaacaacatcaattctttaaatgatgccgaacttgtcgaactgatatcgacgcaaattaattcgattttatcggaattttcatcaaccaaacaagaaatgaacgaaataaaaagtaaatacaacaaaaacaaagaagtttcacgcgaactaaaacaaaacgtgaacaaagtaattgttaatatgtcgcaattaaaagagaaattaaatctttcggataaaagaaataaagaattacgagaaaaattaaaagaaatgaatcagaaatttgacgaatcagaaagaaatcaggcggaacttagagagaaacatcagtctgcattgagattgatcggggaattatggactaagaaccaaacattgactcgaaatgctaaaaaatgatcttaaattatcaataaatacttactgtagaacattttacttttaataaatttgcgttttcatttccaaatggaaacaaaagtttcagaattaaattggatcttcatgatacaaaatgaacgagatagaaaaattaagtaaaaatattttataaataacaataaatgatttgtgaattttcatatcgaaagttttttgaactttgatatccaatgctttgttaaatttatatatttcattggatcgccatattcgctccaaatatctttattatatttgaatttaccatgttcgattgctggttcaatcattgttccttgaagccaattattaaaagagtttattaacacagcgggtggatttgcttcaattgcagctttccacattcgattgtaatattcgccattttcacgactacgttgcaaaattggagaactccatctccttgtttgtgtatcgttgaaaccaggtgatactgtgggaataaagaacatgtttctttcggctgaaatagaactaatcaatttccaattcgaaattgtggatgcataaatatgaccttctgaagcatctagtgtgaaaataccatcatatccctcttccattgacgcgccaacatcacttgaataagtgattgtatttataaagaaaagatttggaaatttagatatcaaagttggaaatgaattgatgaaatttgactctgaaaataatataacaggtttgttatcaatagagaatacggatggattctctttatagttttgataaaaataattgatatctgattctaaagaataataattttgtgaattgtaaaaaggtataaaaattcctactttaatgttataatcaggaacaatttttagtaaaagatcaagtgtttgaattgaaaacttttcaaaaccatcattaaagaaatcagaatggttggttccaaaataatataaaaatatagcatcaattccaattgatgataggatagaacagtgatgtcttaggatagattcattatgtgacgaatatattcctaatttaggatataaagttgatggtatatctggtggaacaattctttctggtgaagaagagcgaatttgataagaccaagatactaaagctttatcattttctattgtgccccaacatccaaagtataatgcaaaaactttttttgaatattttttatattttgtgtctttttcaattcttgagggattgtgtcgtgaaataaataatataattagagataatgtattaataatgaagaaaagaacagttttttcctttgcattcataaagacgtttattggcaggttactttaccttcaaattttgatgacaatttggaattgaattatgcacgtttataattgctaaaatggaaaaatcagaagaaaataaagcagcaaaagctattgaagaattacaaaatcgaatcaaagggctcgaaaatgaaattaagaaaaaacgaaatgaagtaattgtaacaaaggaaaaattaatcaattatcaaattgaaaaaagtgaaagtcatcaaatatcactaaatgaagcaatcaaagcacaaaaaatgctcgaatgttcgtcacaaaatttaattgaactcagacaaattcgaaaagaaaatcaaattttgaagttacaaattcatcaagttcaatcagaaatcatttctatttctcaaaagccatcacacaaaaaaatagaagaaactgaagaacgtaaacataatgaaaaacttctcttagaatttgagaatcttctatcattgcttttatttccacctaactttgagttaaatgtaagcctccaaaatatttctaacagaactaatttttttacatcagtctcagataaaacctattcgataacagcttcagtacatactgttatccaaaagattcacaatcttccatctcctctttcacatcaaaattttcataaaaagcaagaaattgttattatattactaaactcaaagtttttatactgcaaactacttgaagaaatatggaatttacagaaatcaaaaataaattcgaaatttaaaacaagagttcaagataaaatcgaacagaagcaagtgtatttatataaattaaaaagggcaatagataaatatcaatttaataaataatttaattaaatattatcaacattcttggctcaattttattatattgcaaagtgtaatcattccgaattcatttaagtaaactaaatattgattttttatgaatcataaattttgaaatgaattaaaatatctaaaaacaaatatttatttacaatattacctgaagctcattattttcattaagtagctgctcattaacttcgtcgcttccatccctttcttctgctccttcttctgttttccctttgatgccacttttccacatttcgctcaattcgttattgcacgcagcggccgaaagggtcagaattaacaccgaaggaaatatccatagcaacgctggctgtccatgattcattacatgtaccataatccatgaaataatcactcctaaaaaatatcctaaaaatgatatttcgaaatatcgagtacctcttttcaggtcatatcgcatgaaaaagtctaaaacaagaccaggaataacaatgtcacctgctccaattaatgaattatggttgccatttggaatagaaaaagttgcaggtatatgtgctgaggcactagttgcggcaacaaccataacgctcttcccaaacactaatggtgataagaaaacccaccaaacgtcatatataacaaaacatatggatacaattacacatatttttagtgaattaatcttaagaaatgtaatgcctgtaacacatatgcaaaatgttataaggttggttataagccaatgttctgtaataaaccaaattaatggaataattattgaaaagattattgtgacaattagatttatcaacctatgtctaaatatcatccaaaaccagtcccatgaagtaaaaagagaagaaacaaaacatgggaaaagaatgattattttcaaaaattgtaaaaatgattcagcaaagaaaaatataattaaaagaactccagaacttaaaacaagcattaaaacaagaaattttggtgtaatttctgattgttcatctggagttggcctaatgtaatcaggtctactttgttgatgctgtggttcgaacagcaatcctgctgatgccgtacatccgtaaaggatagtggatgatgaaattaatagaagagcaatggatgcgaaatccattttctgtgatttgtgagcgatttaatcgttttcatcataaaaatttcaaaaattcgaccagatataaaatttttgctgaaacacattacacaatatattcttttttgctttttttttttttaaatacataatatattttaaagtatataaggtgaaaataaaagtattgtatttctgatttttttaatttcatatcatcacacaagatttcataaagagaattaaagtgattgtagaaagatttcccaatgatagcatccaaagaatccatcggattcatattcaaaaaacgcacaactcctcgaaaaaaccaaaatcagaaatattttaaaacctaaaattaataaaatattaagtcaacacatttattattttcacacatgaaatcattatctttttgaaaattattgatggattacaaaaaagtttgagctgttcgatgtattgcaatcatttcaaaccccttaaaaatcatattgatttccaatgcattttttgtttaaacgccattaaacgaaaatttacgttaaaatttttatttatttatagtgtcaaatctctgaattggggatatttttggtaaaagttctcgagctcctgctggttcacttcttttctcatgcaatactttatgtagtcgggcgggtggtcactgaagttaccgtgctctttcatcagatgtctgtaacagtcgtcttccacttcgaaagggcctgcgccgcaatagtaacagaagtgttttccgcatgtgcattcgatgtgattacagaactgagtcttttcgattattttatggcaattcgggcaaattctaaaaccttttggcacgtggactttattattacatttacctatttcatgccattgattacattcattacaaagaatgaaattacatccatttacattacatctcagtaatgtatgtgactgtggagttctatataatattgacatatgatttggacaatatgtaattttcggtgatgcttttaatgctttaacagctatagatgttacataagctttggttacatttgttaattctttttcatgaataaacgcccatattaattgtccaaatggtattatcggccattttcctaattgattaatattcgtctcaaagatttctattggtcgaattaagtcattgttttcatatattttatctatacgaacagtttcagaattttcatcatacattttacctaatgctgcaattaataaacttttaatacaaacacaacaataatttaagttttgcgttgtacgattttgataataaatactaataagtttcttcgataatattaattcttcttcacaacaatttacataattacctaaaatttcttgtgaattattttgatcattatttatattaaattgattaataaatgttatcacaatattatcatcaatagaattcggtactataataattcgtttcgatggattaattaaccatttcttttcactcggataatccttgttttgaattgcattagttaagatttgaatattaattccaccaggtatagtaatatgtttatatggaaatgttggtggttctttaagtaataattcattaactttattaatttgatcgatttttccataccaaacattgttattataattcaattcgatttgatgctgtttaagatattcattaaagatattaatacatttcttcttagttaataatgtcggatcaattatattcgttggaatatataatacattaatatctttacctaagatttcatcaatgaacattgaagctaaaggtgtaataaattcgattgtatacatataagctttaatgataccttttaagttattattattaacttcaatatattcattaactttatatattataaatccaaagttttgtattacattttgtactttttggataaattgttcttttgtataattcgaattctttgaatgtttaaattctacttcataaattggcatttgaataatatttgtattatcatatttaataattgatgtaattgaacttataaatgattggatgaatttattagttttatctatattattattattatcatttattatatcaagtgtaatttcattattatcatttaattttattagattatatttatctttaattttatcatcaattctattaaaaacatttccagtaggatttattgttaatgtttttattggaatttctttttctaaatgattatttttaatattgtttaatattaaatcattaaataatttttgtattttattttttatattattattattacaaaagaatattcgttttccataattcttaaatgtaaataaattaggacatatagtattagcaaaattattcatattaaaattattttgttgattattatttttgaaccaaatcatttctttttgatttggaatttttttatcagataaaattattaaatgtgaaaaattatttatatcaaaaacataatttaaattacgattaattatcggctttttaatgttatcataagaatattgattattatctaatgataatgataacatttcaccagtcatagctatagttaatttattagtaacatcattaagtcgactaatataagttaataaataatttaatgtatccttattaatttgatatggatataatactttttcattaaagaaaattatattcgaatcttgtttttctgagccaataactttaagagatatacaacattgaagattaaagtgaggaattaatatagatgaaggtgtataaggtaaaagtaatgaaacatttttaatagcttcattaaatatattttcggcatttgtatttttaggtgaataagttattacactttgatttttatgtattgagatacaaaataatgttttttcattatcattatcatttaatttctttgtattaaatttacaaaattcattttcattaggctttaaatattcttcaagtaaaatagatgaaaattcttcttgtgctttaaatacataatctgttgttaatgatatcggtttatataatatataattgttttgtattgacaagtttcgttcatgattaaaatcacgatgaatatatgtaccaacattagtttctgtagatttattatgtacaatatttaatatataaacacaacttggtgatgtataacctatagatcctggcctcattttaactataacttttgattctttttgattattattattattaaatgttaagttttcattacctttataaactattaatggatctttttcaacattttctattgtttcaaacataacttttcgacataatgaccattcttctttagaagatattgtagaatcaataatattttgtataaatttcattaaatcaattctcttaattaatttatttaattgtttaaatatatctttttgatgaatatttaaattccttgatattgttaatattgttgaataaatttgatatgctaaattataatttaagccataatcatttgttaaacatttccattttctaatatctatttttgttaaatccaaaaatgttttaagaattgttataatatcagaatcattacaaaaattatgttgtaatacttttgcatatacatcagttattaaattattagtagaaaatattaatactattaatgaacctaataattcaactaatgaagtatctttatctacattcttagatgcattaataatagaattagctaaaaatggtggaattgtttgaaacattgaaatctttgatccatattttgtaatttcacctgtttctggattaatagcattaaatttatataattcattcataaattgttcaagtaatttaggctcaattttatccggtaaatttgtaagtttttcaagtttaatatccatttttcgtaatgataatatattagaactaatatcagtagttaataaatcaggtaataatgaatctttcattggcatatctttgataactatttgtattgatattcctggacatactctacctacacgacctttacgttgtgtttgattttgtgttgatattaattcttcatttattattgttaatccacatgttggatcatatatagattgtttatataaacttgtatcaattactacttttaattgatcaattgttactgatgattctatagcatttgtagctaaaatgattttgataatattatcatgatcttttatcggtctcttagctatatctttttgattttgtgttacataacctgtaaatttgataggtaatataaataatgtttctttatcattattaataattttattaatgttcttattaaataattcgatgttattaaatgatatattattaataacttgtatattacgtttttcattatttaaagttttaatcagacctaaaatatcatgattaatttcattaattcgtgaattacctgatgaaaatataataatatgaccaatttctaattcattattagccattcttttaataatgtttatagtttctgttgctgctacttttgttactttatttttatcttggatttctattttaatattttctacagggaaaagttgtgaatcttcaattgttatagtcttaacatctttaaaacatttatttattgaataatcaggtgtagcagacatcattaatatatgtaaaggaaatgtgtttttgaaattgatttttcttgataataaagaaattaatacatcagtttctactgttcttttatgaatttcatcaagacaaaatcgagttttagatataatatcaataccttctttctctgtttctgttattaatcttattaagttatgaggtgaaaataaaccaatgataggtttattaatttcatttcttgaaatcttataataattaatcattgttttaatatcattagttaaaatgactgtatcttgcataatatctttaaaatcattaattttatctgtaattatatttgcacttggttgtgtcattataaaatatggatgtttgaaattttccattaatattttaagtgcaaatataaatggtgaacatcgagttttaccactacctgtagaactttttaacataataacagaatcatgtttttttaataattcataatgtattaaatatactggataaatccttgtaaataatgaattttcatcagatggcttgaaacttaaatcaaagaataaatctgcaatttgtttaatcgtagatttattacttaagaatttaaaatatatagaaacagctttaaatgtttttaatgtattttcaagatataaatcattttgttcatttgtattttcttctttttcataataatgtagtaagttacaaaatgattgttgaattaataatatttgacctggtaatttcttattagttttgaaatatgtcgatatttctttgatatattgtaatattttactttgtttatctttatcgttaacatccattttttcaattatttctttaatatttataagaaattgttgtaatgattgttcactgatatcaaattgtgataagaaatttattaattttggttttatatttgatggtggtactatacatgtaaaaagttgattaattaatgagtttgcttgttcccattgagatttatctaaattatatcttcctataattctaaggatttgattaatgtttttatttcttaagttaaaaatatgattaaatgcatttaataatgatcgaatttctttctctgtaaatgaatcgaaatttaatgataatataactttgttaataatttcttcatcttgtgcttgtactttaatagataataataattcaactaattcttcatatttaattttaggaaatgatgaaattatttcttcgatattatccataacttctgttatgcctataatcattctcgaatatatttgttcaatgttaatattttttacttgttctataataaaacctgattcttgtaattgaagaatttcttcaaatacatctttagcaaaatattgatataaactagtgggaataggtaatgaaataatcgtaaatttagagattactaattgggcacgtttaactccatcaggtaaatcaaatttaactgtttcaaattttgtccattttggtgcttctacaatttctttaataggatcactttctcttttaatatatttaagattaattacgattttaattgctaatataaaaatggttttatatatatcattgttttgtgtaatttcattcattctttgaactttaatttcattttcatgttgtttataaatagcattcgaaagttttgttgtaacactattaatgtttctaattggatgttgtgtaattaatataccattagatgtaccatatccataaaaattcttaagatttcctatgacatatgaataaccatcatataatgaagcaaatttcgatttaattagactttcatcattattcatattaggtatatatgtaatctttgttagatccgaacttgaattaataaatttatatggaatttcagtaagttcttcaaatttttgattggtagaaaaactcttcttaattacaatgggcgctgacataataattggtataagcataaaatcagatacagctttatacgaataataaagaatttgactacatgaaatagattgattgtttcgaatttttggattaaaattctttgaattaatattaggctcacctaaaaatcttcttgacaatgaaaatgtgtttttcgagagattttttaaatttaatatttggctcaagttgatatatgaaaaattacttgagtaatacatttgtaatatttcaatgtctttttgatctttgatataaaattgcgttgacataaggaaactataaatagttggattaggaacattatctacataatgaatacataaaataccttttttggaacatattaaaaataaagaaatttgattgtgatcgatttgttggagttcaattaatagaggtggggtttgatagtgtatttgaagatagtaaaaaagttctttatcagttgattcaatatatgttactggaactttggctcttggataaaaatcaactatgacttccttcttatttggccagctatgcttagaaaatttatctgatatgagtgtttgattttttgaaaagcgtagaaaatatggtaatttgtcaaatgttaacgatggttgaatcccttgattataagtaattgtaataatggggtttatgttatttgggctattaaaaggctggtttgtatatggctgattgtaatttattggattaatatttggtggataaataataagctggtctggtccttggttaaaatttgtggggaacccatttatttgatcagaggtggagtaacctgcgtagttagtcatttttttgaaagtatgccacaacttacacccctcattctgattttattatcggcgacggttttatacgcaattcccaaacaaaacttgtcaaaatatgatagaaaaaacgaaaaacactttttaattgcattttgatcggagattcttcaaatattggatttgaactaaaaatgatcgttttgcattttaatttttgactacaaaagtttttggttaaaatctttattcttatcttctttttcattatatcgacagaataatttaactactttgtttatgtattgggtacttcgtgtaaaataatatttattttattaaattaaagaattttccttttcgcttttttgaagaaaagactatcaaccgtttatagccgccaggaattcatacaatgtcttcaggaagtgggatttctgcaagcgactacattcgtcaaggcgtcattggacgcggtaattttggtgttgtttttaaagcaatttgtaagaaaacaaatgaaattgtagcaatcaaagaaattgatcttgaagaaagtgatgacgatttaattgaaatacaaagggaaatcgacatgcttcgttcatgtgaatcagagtatgtcgttcattattatggttgtacacttgttggcactaaattatggattgtgatggaaatgatgggtggtggttctgttcgtgaactcattcaaatcaaagtcatgcctgaacctcaaattgccattgttctttctcaagttctacatgctcttgattttcttcatcgccgtagaaaaattcatagagacattaaagcagccaatattcttcttaataacaaaggcgatgtcaagctagctgattttggtgtagcttcatcacttgaagcacgtaacaaagcatttacatttgttggtacaccattttggatggcaccagaagttataatggaaagtgggcatgatgaaaaatgtgacatatggtcacttggcattactgccattgagatggccacaggccttccaccatatgctgatatgcatccacaacgtgttcttatgcttattccacagaatgccccacccacacttgaaggtgatttctcgccccagttcaaagactttgtctccaaatgcctcacgaaagaccctaaacttcgtccaagtgccagcacacttttggggcacccctttataaaaagtgccaagcgtaaagatcttatcgtcgagtacattgaacaagtgaaaccatattcttcacaagtaaacaatgaagaagaagagtacgaagaagaagaagaggaagaagatcaaaatgatttctgggtatttgatacagtccatgtggaatctaagccgaaaacgaatcaaagtaatacaaataaatatcttgaagcacttgagtcagctatattaagtacttcaagagatcaaagattcgcacaagttaatgagccgctgactaaattgggcggattgtttgtgttgtgcgattcacgttgtcctggatttgcggaggacttcgtgaaggcattattggaataatggatgaaggaagtgtttatgtgtggatgttcctgctcattgttcctaatgaaagaacacaaaattatatttgaaacagaatttaatatgttgtcaatgaatttatttgattttgttgaatttataaagaaatatattataataaaaatgagttaagttgaaggttatcaatgtatatttacataaaagttgtttaatagtttcattttgatctcgtgtgtattggttcaaaaagagttaatttgaattattttttaatttatttctttttatagcaataagagatattttttgagaaatttcctactccccagttcagtttttggtaataaatcatttaactttagaaggagcttggtataatagtatctggtttactttagtttatgtatgcatcaggttcaaaggcacaaaatttctcaataaatgttggatcaatcacaaatcttagaatttcaaaatatgatttggaaattaaaatattttaatggacagcacttactttagcatctaaaattattgcatgtttcaaagaaatagctaaattgcaccaagatacctatggcattaaccaaatttctatctcgttcttttttgtagattaaaaaaaaaattgggtattttttttaaagtaatacttttagtaaagctctttacaaaatatataaacgagaaaaaaaaattgtttccattaacttgaaaaatttgataaaatatttattgaaaatgaagtccgccttcgttaaacttttgtaataatgacatgaaatcctcaatatctaactgcattgggcgcgagtccataattaaaagatcttctagacacttttgaacaaacacatcaatcggaacgtcagttgtcaaattgtgcgcaatcaaaaactgatttcgattctcgttaagtaagttaagtatcttcttcttcttgaaggtcgcttggagtgttctgtttggacggttaaaacaaattttaattaatccatcccattcattaaaatcgatgtttggttgattctgtcttggttggatagtaataacagcactgtcgacttttggagcaggtacaaagttctttctgttgactgacattactaatttgacatttgcaaataactgtgtatttatcgcaagacgtccccaaccaccagatcctggacgtgcaacaatacgctctgcaaactctttctgaaccataagaacagcccttcggaatgtaggccgtgaaagaagtttaaaaacaattgctgatgaaatattataaggtatgtttgatatacataaatcaaattgaggaagatctactgttaaaacatctgcatgaacaattctaagttgtgtttgaagttgtctttgaaatcttttttgtaattctacaaccatacgtggatccttttcaacagcaataacattgcatccacgagaaagcatttcttgtgtcatgttaccattacctggaccgatttcaagaataacatctcctggatgtgtttctccgaaatcaactatattttttacgacaactttgctttttaataaattttgaccaagactgtgatccatttggaaaagtcctgatttctttggtgcccttctgacttgcgccatatggaatttttaccaaatttaacgaccaaagctaaaatcagttatgtgatgtgaaaattcaaaatcgaacaaacatcgttaaaattgataacaacactgatcaaaaaatgccaattgaatcagaatccgaaagtaacatgatttaaaacacaagcttcaattttctggagtaaaaaaagtgagaccaacatatattgtgtctgagaaaagtattattaatttcattgaaattgtaattggttggtatagagttgagtgtgtatttgcttgatatggcgaagatcaaattgtaatattgaaaaataatttgtattatatagtgtatttggtttttccttaggatttgataagaccttattttactatacttgctaaaaaagattttatgaacaaagacaggagaagaaatgccaacatataaaccagaacaaatagacttacgtattttgctttgattcgagtatcctttttataaatggatacttaacgcactttttcaataaactattgacttaaaccatggcatatagtatttgggagaacatgcgaaaacgcaaaacaaattcaagtaaaaaagaaaaaaatatatccccaaaacatagaactagaattatcatctgagcttgaataaatcataatgaatctaacagaagaaaatataaatttgttagctaaacatacaacaaaaatatttgattttaatttaccatattcatttaatcttgttataatgtatacattaaataatttaatttattatgcatttttatcacaaagaaataagtgtactacgtattataaattttaagaaataattcaaaaaaaaaaaaagaagaggaaaaaaattaattctaaatacaatattaatgaaatatttcagaatctattataatattatagatcttattttatatatataatatatatgaaatttcaaaaccgtcaaaaattgaatgcgatttcacgtatctcgaaaaatagattatcttgaaaataatgaatgatttaaaaacacttaataactaaaatttatatcataatttaaaaaaatatttgatttaatgataataaataaagatatttgaatttaaaaattattaaaaccgttttgtttcaatgaaattatttctgtcatcttatttcaatgaaaacagattcctccccagtaacgaaaaaattgaaaaaatttttattaaaaacatttggttcgcagtgagtcgttattagatagtttcataaatgggcatcggctagccgataaaagtcgtcacaaagtataatttacaattgtttattaatgtatagatttgtattatttcaaaaatgtttttaacattgatagcaatttctttttatttcggaaacaattgtttttaacagcaatctctgtcctacagaacatagttgcagattcaagcgctgttttaaatattttaaatgatttccaagaattatttttaaagccaaaattatcaaaataaacattatatataacacaaaaaatgtctttgacattaaaaccaattcttatctatatttttatactcaacttcgcggaggcttaacaaatggattacttggcttcctccttttctttttgtggaacaaatcttcttcttcatttttctctggaacaggttctggtggtttaatctctgctacaggtggaggaagaggaggagctggtgctggtggcggtacaacttgtgttttcttgaacaacgtcaaaattggctgaatccaatttgatgctctttggagatcttcatatgattttgcaccagtcattattattttacctgattcgaagataagaagtgttacctttggatcagggatgcgatatattatgcctggaaacgtttctggattatatctggcaagttgacgatgacccggatgatttgcaatttcttgtaaacgaatacgaaagttacaagcaattgtggcaacaagattcgtaacattaaattcctcaatgcgacaattgtaaccaacttttcgaagaattcgacaaaattttttggctgcttggtatgcaacttctttttctcttgttccaactatgttaactttacctacttgaaacaccatagctgtagctttaggtgttgtaatacgtaatataactgcttggaaacgtcgtggattaaattctgcattttttatatgttctgatatttttaatagatcaaagctattacacatcttaacagaagcaactaaattgacaatgtttggtttcattgaatcaatatgttcaagaaaatcgtctgcatcttcagccaaattgtcatcagcaagtgcactatatccctctaatgtcttaaggtcttgaagatttaaatcaccatcatcattaacaccaatgaattcataagattccatgggttaataatagttaatcttggatgaaatgtttagtaaaaaaaattccctgaccaagaaaccgtttaatactctttgatccaaacagaaaaaagcatgacttcacacttcccactttttgatagaattcatagaatttattgtgtatggtatatcaaaaagtgagttttacaacaagtagattaaatacctaaatttctgaataggagtttttatctatcacggataaaactgtgggggaaaattataataatataataatataataatataataatataataatataataatataataatataataatataataatataataatataataatataataatataataatataataatataataatataataatataataatataataatataataatataataatataataatataataatataataatataataatataataatataataatataataatataataatataataatataataatacaaatataagctcagcattgagtgcaggtaacccaaataatatctttctcgaaacgaaaattatattaatgattcaattccctattccaccattacatatcaaacatttcaaacatttataaatatatctctaaactatgcgaagtaatccaacacagcctttttctttgcctgcacctgtgctattccttctacgtaatcattatgtacgatttcgtctgcgtttcttcttaatgccaccattcccgcctcgacgcacacagcctttagcattgctccattaaagtcttctgtcgatctcgccaactccctaaagttaacgtcgttgcccgtcttcattttgcgctaatggatttccaatatttgcacccgcgcgtcttcattcggtagcggcagctctattttcctgtccaatctcccggacctcatcagtgcggggtcaagtgtgtcgggccgtcctttcggtggttggattccaagcttcttaatacgctctttggagggagatataagaggtaaaactactgcttctttaagttcttggatttgtttttctaatccaccaacttgatcatacgtttcagtcggcttggaatcaacttccatggctttcactcgtgaatcaaaatgttggggaagcttctcaaatatgagatatgaatctttggaaagtccaaccatatcagatggctgaagatctgatgcatcaactaatccaggaacagggagaaaaactgtctcacgagtagtggttttgacaacggcggacttggagtcaagtccacgataaacactatcagaagattcatcagaatcaagtgaaagtacttcaacaacatgagcaacaagaaatggaagtgtacggttaagacgtatcttttcattattggaacgaatatcttcttccatatgagtcttttgattttggtattgacgtaccatgttacgatatgcattgattttgttttcgagtatcatgttttgttgttcaatttctttcgctgatttttgttccattttttttatttgatcatctatgatccagtttgtgaaatcatccattttgaaaaattgactatctttgtttgttttcacatgaaatttctttgttttaaatttgacatcagcaaaatttttggaatgttttgaacaatgaataaaatatatttgaagattattattgagtgcatataagatatttttatttaaattttttacatggaatgaatatataatcatgcatgatatcttaaaagtaaatttatttaaaattagaatttaaaataaaattaatattaatttatctattctataattatgcattattaatgatatatttaaaaattatttatttttgaatttgttgaaaactaagagaaaatgttagcgctgtctttctatagaaagaagaggtatacatcatgaatcatttcattatgaaaaaattgctaataaaatgctgtaaaaatatttagaattttaaaattaatttttcatagttgtttgaaagtagacattttttcaaggcgactttatatataatatatattgtatatacattattatttagtttgaatatttttatccaaactatattatgtatataatccatattgtatatgcatacatagactaaagtaaacaaataccaagttccatttcactgttaaagtttaacaatggttgtaatcattttattgatttgttcagttgggtacgtatgaaacccctcaaaaattttgctattaaaaaattagaaacattaatttatactgatttattattgtaaaaattttatataatatgaaaatcattatctttttgtggtagaagtattgctaccagtaccaccaaaaccagaaccaaaaccagtactaccagtaccagaaccagtactaccaaaaccagtactaccagtaccaaaaccaccagaaccaaatccaaatccaaatccaaaacctgtgccctgcgtttgaacaggtttagtagaatttccaagcaaatctgattcttcgttccgctttgtaacttttcgcttcctatcattaagaaactgtttatactttacttgaatgttttgttggtaagaactttcaaactgataatcactgaaatctaattgagaatgtgatacgtttaatttagattcaagttctgatcttaccgacgtaagttttgcttgtacttgggaaacacgtgctgagcatctaacaattgcttcgtgttcttgtgataaaagatcgaccatgacctgcgatgaatttgtggttatcttttgttgtggctgaagatatcttccagcagaagctaacatgttctctagatcaatggccatcttgttgatttttgcaacatatctcctaatgaaaggagttggaggatctccaatatgtgaagaatttgtaaggtctgattttgctatgtttaactcactttggagttcttctaattctgcttttccgtggtcaatgttgtttgcaactgatgttaattttgtaagaagttcattcactgtttcttttttaatgctttctactaaactttcaatattttttgatgaatatgtagttgactttgcagctggttctttatgtgcttgaattgttttgtatacatcaagaaaatctttctttaaatcatttggtaattctgttaggagcatatgttctgacatctggaatggtggtttttcttcttttggttgctgattaaaagatccccaattaaatgtaaatccaccaaaggacatttcaaaaagtgtcaggaataggggcaccccaatttcctgggaaaaaatcgaaattttcaaaaatcaaaaatcgcttttgctaaattctgcataaaaaacactttaacacatctcttaaataacgaagaaaaaattaaaaattatttaataacacaaaaggtttccttaacgcaatatgcctccatggagaaggtgaacgacctgaactcgatgtaactacaactgtggtaccacagtaatcccacagtggagaacaaaaaagtcttgttagcacaaatgggtatgacaatgtttttgctttccaaagaaagccaagctccgagagttatagcgcgaagccaaaacatatgatgtagtttcagaaatgcgagcgattgtagatgaaatggttgaaattgcgagattcgattggagcaacaattcctaagattgatttatccacgatcagataataatctgaataactcgtggttagtcttatgcggctcatcaactgataatgcatacatagcatatgcgcctgttacaaattcagcatttaaaatgggctttagctatggacaaccatccagttgtccaagttcatgatgcattagcttatcgtaattggaagtacaacatttacatactcagtcgcatccactagttctagtacagtaagtaacgtaatggaaacgtattctattgattcggatgctgccgaaatttaagtaaatgaaaataataaccataaaaatgtataagtttttgtttaaatgttaattcgttatgcacaacattttatgtattatttcattcagtgtgatgtttttaatttaattcacataaaaaatatattggaattccaagcaaagatgaataaattgatcaagaattcactcaactttttggtaatgatgttgatgatcaatgataagaaaatactattcagatgaaaatatatatgaatccttttatcgaaaaacatttaattattaattccacaatgattcatatattttttctatttaattgattctgagtagtttcattctgtattattttcttttatctcatactgtgcgatattaatatttaattttttgtttatattgtttctgatttgattttatatacagtaatattaaaatttgatgtataccttataatattttaatttgattcatcatattttctgtttattgattttaaaaagatgtatatactaagtttaatcattttctgttttaacttttgagtttgatatatatatatatatatatatataattaaatttttttttctttccagcaaattcaaaagatcacagcaacaaagtaagtttatccgattttaatttgataatcttatataattcattctgtgtatttttttttcttttgattcactttcgaaacattttataacaaaatcggctcttacaaactttaataaattttacattaattacattttactttcacgttactcagtaagggttaccattttcatcgaattccctccacaacttaattgttttatctgcctcgcatgtaattaatcttgtaccagtcatatcgaacgcgcagtcgaaaataccattttcgcaatcgagtgatcccggatgtggaatcgaagtgacttcttggaaacattgtccgcttccccaatcccaaaactttatagtaccgtcatcgccagcgcttacgaacacgtcatcttggttaattgcgagcgcgtttttgatgcttttatggtacttgaactctttaaatagtttcgattcttcgccattccaatggaagatggcgtcctgacttgcggatgcaaaactccactctttaggatgtaacgcaagtgcacgaacggtctttttatggcgcgtgagtgtgtaaagacatttactgccgttgcgaaggtcccacgcgcgaatggttgcatcggcggaactcgtaagaacattgggttgaaagtcttgcatcttgacgtcaaagacagtaaggtcatggccctcgagaacaaaaactgagtcccgcgttcgaatgtcccagatgcgacatgtcgcatcacgcgaaccagtggcaaagatatcaatggttggatggagggaaagacagtaaacgccagaaagatgcccatggaagtcacggacaatggaattttgattaagatcccagcaataaacacatttggcgtcgcaacaactaaaaagatatggagagcggttggagatttcaaggtcttgaatggcaccaatatggcctgtaagtgtcatacgaagttctgctttggcaagatcccagattttaagcatacgatcaatggaacctgtaataaagaattcattggaaggatcaacagtaacagctttgacccaggcattatgaccagtaagtgttgtataattataccattgacgatgaggtttagcagctggtagaaaggtttcaccatgctctttaccacgctcaggacgaagatcaataacttgagtaggttgaatagtttcaactttttgtggttttgaaacagacggaaggaaatttgaaacacgattagaatgaaaagaatctttaccaagacgaatttcacgtgtatctgtctttggaagttgaaattcagatgcttcaaataataaatttgtcttggctttattttttaatataagttgttcccaatccattgtggtcaaattgtcacttttttggtgatattttttaacaagaaaataaaattatattatttcattattcgaactaagagtcataacccagcaataattcagttgcacgaagacattttgctgaatgtattaatttgatcatcaaattatcaaatcacattttttatgttcaaataaaatatatgcagtttttaacatacacagtggaacctacttataatcagataagaaaaaggaaacattatgatcacatttattgttacctccaaaaaaatatttgaaggcatattgatcaaaattaacagaattatctatcgtttaataataacgaactaacaatgaaaaagtgaatttcatactcattattttgattgaaaacatatttatgtcattaaaattctatgaatttttttttgacataaaatgatggataaaaacttcatgtcatgggatgcacatgatgtttcaaacaatctatcatcaaacgggtatgattatgcatccgacatatttcttgataatgatataacaggagatcttttaccgatgataaaagaagaacatttgaaagacatgggtattttatcaattggaaaacgtctacttctactacagtatatacaaaatttaacaaatcaatcaacacagaaaccaaaattctcccaaattgaacaatctccagcaagaagtcgccccactccattagagcaaactacaccaagaaatcgctcaagccaagagcaatccaccacaaaagctcgttccgctcagctagaacaatcaacacctcgaagtcgttcaagtcaacaagaacaatcatttgatagaacaaaatcagtttcatcacgatcatcaacaaaacgtgtgcaaacagcttcaagccaaaaatctacagatgatgtaccaaaatggcaaaaagatcatgacaaaatggttgaaagcattagagctgctcgtaagtacgcagcataccaaaaagcagttgaagaaggaagaaatgttgggccaccaccagaattaccaccaatcgaagaaccaccaggattggttgcatgtccacattgtggtcgtaaaatgagtgaagatgctcttaagcatcatgtaacaggttgcgagagaatgaatagtcgaaaaaacgcaacaagaagaggtcgttaatatatccgtaaaaaatattatttattattcattgttaattaacatcattaatccatcattgattcagcttcaaacaatatttgatcaatttctggtgtatttaatgattcttttcttctttctttaattataatttctttattgttttgatttggagaaaaccgtttctgtatagcggttttgacaatgttacgatacgtatcgtccacgtcacttttcgtttgggaatgtgtcacttttgaatgcgaaatctttggatggaaactacattcctccatttcttgcatttctatgaactgcttatgtaattgacttgcctcatatcgatttttcataagctgaacagattgtttaaatagctcacatgatcgatctctattattatcgtattttttctgtttattttttttctttggtgtttcatcgatttgattttcttttctttttttcattaattcgacagattcatctgcaagtctatttatcacagaataatcagcatatttctttggtttaagttcatcttcgtcattatcatctgaaatttgtttctttggagttgataatcttcgaaatgttttcgtaagttcttcttcggaatatctatgtgatttcttcctttcgattatcggtggctgatatacttctgttgaatataaactatgctttttagtggaatgggaaataatcttctctgaaactttgtttatgtattttttttgtttttgtggttgcgctgaatgagcttgctttgtctccctttgtggaattgatttggttggagtttgatactgtgatacaataactggcttaaatgtacattctttcttgaatttttcctcttgttcttctttagacttctgaatgaaatcatttcgtttactttgtgtttcttgaattctttgtgaaagtggcttgtagtttaaaattttaattttgttctgaggtggcttatttattagattgtttaagccatcactttctgtagaactattattagataatgaattatcgtcagcattaatatgtttacttgcttttttactaattttattttttggtggttgacgtttctcttttgttggatttttatttgatacagtttctaattgatctagattattatctaattcttgtgatatgttctgaatctctttgtccaaatttgtaatatctttagatactttgtcgatccttggggaatttatttgcttggattccatcgtaggatcttttgttgggaattttatttaacgttctcaaaattttaaacggtttcttttaagatttaactgatttttgtggtcgagtgcaatgagaaaaattcctcttcttacaaataaagaaaaaattgattgggggtttaaacagcttcctttaaagtcaggtacagatgatttggaaggaattaatgaaccagaaattctaccacacgattttaaaaagaatttcacaaataaaaataaatccgaagttaaagatacagaaatcaattcggtgccaacaacaaaagaaaaaacagaaacatcaggtttcaaattcattaatcagacaatttcttcaagtgaaaagaaagaaacatcatcagcaccagtatcagaatttaaatttggaggccaaacaattttttcaagtgaaaagaaagaaacatcagcagcaccagtttcagaatttaaatttggaggccaaacaatttcttcagcaacagaaaagaaagaagcatcagcagcaccagtttcagaatttaaatttggtagtcaaacaatttcttcagcaacagaaaagaaagaaacatcagcagcaccagtatcagaatttaaattcggaggccaaacaatatcttcaagtgaaaagaaagaagcatcagcaacatcagcagcaccagtatcagaatttaaattcggaggccaaacaatatcttcaagtgaaaagaaagaagcatcagcaacatcagcagcaccagtatcagaatttaaatttggtagtcaaacaatttcttcagcaacagaaaagaaagaaacatcagcagcaccagtatcagaatttaaattcggaggccaaacaatatcttcaagtgaaaagaaagaagcatcagcaacatcagcagcaccagtatcagaatttaaatttggtagtcaaacaacttcttcagctactgaaaagaaagaagcatcagcagcaccaggtcttgtatttctaaataaaacaacagaagttaaagcagaaacaagcgaaaagaaagatgcatcgttttcaggatttacatttggaaacacaccaatagaaacaaatgaaaagaaagacacaacattttcagggtttacatttttaaatcaaacagcagaaacaaaacctgtaacaaatgagaagaaagacgcaacatccactggatttacatttggaaacaaaccaatagaaacaaatgaaaagaaagacacaacaacttcaagtttcacatttggaaacaaaccaatagaaacaaatgagaagaaggatgcaacatccactggatttacatttggaaacaagccaatagaaacaaatgagaagaaggatgcgacattttcaggatttacatttggaaacaagccaatagaaacaaatgaaaagaaggatacaacatccactggatttacatttggaaacaagccaatagaaacaaatgagaagaaggatacaacatccactggatttacatttggaaacaagccaatagaaacaaatgaaaagaaagacacaacaacttcaagtttcacatttgggaacaaaccaatagaaacaaatgaaaagaaggatacaacatccactggatttacatttggaaacaagccaatagaaacaaatgagaagaaggatacaacatccactggatttacatttggaaacaagccaatagaaacaaatgaaaagaaagacacaacaacttcaagtttcacatttgggaacaaaccaatagaaacaaatgaaaagaaagacacaacaacttcaagtttcacatttggaaacaagccaatagaaacaaatgaaaagaaagacacaacaacttcaagtttcacatttgggaacaaaccaatagaaacaaatgaaaagaaggatacaacatccactggatttacatttggaaacaagccaatagaaacaaatgaaaagaaggatacaacatccactggatttacatttggaaacaagccaatagaaacaaatgaaaagaaggatacaacaacttcaagtttcacatttggaaacaagccaatagaaacaaatgaaaagaaagacacaacaacttcaagcttcacatttggaaacaaaccaatagaaacaaatgaaaagaaagacacaacaacttcaagtttcacatttgggaacaaaccaatagaaacaaatgaaaagaaggatacaacatccactggatttacatttggaaacaagccaatagaaacaaatgaaaagaaggatgcgacattttcaggatttacatttggaaacaagccaatagaaacaaatgaaaagaaggatacaacatccactggatttacatttggaaacaagccaatagaaacaaatgaaaagaaagacacaacaacttcaagtttcacatttggaaacaagccaatagaaacaaatgaaaagaaagacacaacaacttcaagtttcacatttggaaacaagccaatagaaacaaatgaaaagaaagacacaacaacttcaagcttcacatttggaaacaaaccaatagaaacaaatgaaaagaaagacacaacaacttcaagtttcacatttgggaacaaaccaatagaaacaaatgaaaagaaggatacaacatccactggatttacatttggaaacaagccaatagaaacaaatgaaaagaaggatacaacatccactggatttacatttggaaacaagccaatagaaacaaatgaaaagaaggatgcgacattttcaggatttacatttggaaacaagccaatagaaacaaatgaaaagaaggatgcgacattttcaggatttacatttggaaacaagccaatagaaacaaatgaaaagaaggatacaacatccactggatttacatttggaaacaagccaatagaaacaaatgagaagaaggatacaacatccactggatttacatttggaaacaagccaatagaaacaaatgaaaagaaagacacaacaacttcaagtttcacatttgggaacaaaccaatagaaacaaatgaaaagaaggatacaacatccactggatttacatttggaaacaagccaatagaaacaaatgaaaagaaggatacaacatccactggatttacatttggaaacaagccaatagaaacaaatgaaaagaaggatacaacatccactggatttacatttggaaacaagccaatagaaacaaatgaaaagaaggatacaacatccactggatttacatttgggaacaaaccaatagaaacaaatgaaaagaaggatacaacatccactggatttacatttggaaacaagccaatagaaacaaatgaaaagaaggatacaacatccactggatttacatttggaaacaagccaatagaaacaaatgaaaagaaggatacaacatccactggatttacatttggaaacaagccaatagaaacaaatgaaaagaaggatacaacaacttcaagtttcacatttgggaacaaaccaatagaaacaaatgagaagaaggatgcaacatcttcaagttttacatttggaaacaaaccaatctatttgaatggtaaatgaataacagaacaatttttgcagataatttttcgaattcataaaaaaaattacaacttttttgttaaaatgtttttttacaacaatgtgtcatgctcattcattctgttttctttcagaggtgtttgaccattttgaactataaaaattttaagtaaacctatgaaaaagtgtgaaattctctccaaacttgtgtatggattttggtgatttcagaaactattctattgaagcatacaataacattatccaacaaataagaggaaatgagagcagtcaaatagaaggtttaacaactctttcaacaactttaacttatggtgatagagaacttctttcatcatttccaattgaaatcatctgtgccgaaattgttcgtatcctttctaccacagataatgaggttattgggaatttagcttcttcttgtatatatgctgttttggaagcacatcatcgttctacagcaaatcttatgcaagccaatgttctccaagttcttaaagataagcttaccgatatccaatggcatgaaactgccgaaaattgcattttagcgcttgatattatttccaaatttcgagcgcccgaagtaggtatgcaaattggaattggcccattacttgacaacatcggtgctttttcattgcccacacaacgtaaagccattgaagcgtcattacgaattacaaatacttttgtttctgatgaattttccaagtatattgagccattaatcacgatatctgaaacgaccaacaacaccgccatgaaggatagtgccattaaggtaattaacaacattggctctcatgtctctccaggatcgattgatgaaaaagtcattagcagtttatgtaaaagcaccaaattcttaaccacgttaattaatttatccacaaaagaacaattttctgaaaaaatcatatcatccaatgttgacttcgaatcattatttaacgaatcgaaaacattcgaagcacaagaacgagtcttaaagtttgcactcaacatgttaccattaataaccaatgtttcatcatatgattttccaagacataaacgaccaaagaactcaaccacatttgcgaatactattcagccaatattaatcaaagttttattagaaaacccattgtgtcctcggtatttgttaatgtgcattgcttcgactttaaaggtaaaaaaattcgaattaacagacgaaataatttccgcgttaaaagggttctgtgaacgtgaaagtcattttgttttaatgatattattacattatgataaagatccattagtttatgagtcattaattttggatgacttaaggaatacagaatgcaattcaagagataaatcttggtacacaaaaaattttaacaaattaaaaaatactgaaaagtcatactcaagtaaatcaacaaatgatttcgcaaatatgggtacagatgaaattatagaagctataaaaaaaggagaaatttcaaaattcaaactttacaataactgcactgaaattttcaatgaaaacttcgattttgaacacttgaacgatgaacagattcaaattttggctcaatttcttaacgatttcttatcgttcgtgccgataccttcaaaaagaaatgcagacattgataactttgttgacaagtttacgcgcaacacatttgttacatttaaaatcccaaatggtgatacaatccaaagatcagtaaagttgtgtcaatcaatttctaccattgaagggttatataatttaaaagttaatgatgaaggagttgaaaatttacttaatgcaattcaaaataatatacaaatgcaacattttataacaatggaagattaccgaaacctaacagtaacacaattatcaatattggatcgagcatttaatgagaattatcaaaaaatttacgtaaaagaacaaaacggtttattttacacagtgaattcacctttgctcagaattggaacattcaaagaaattgagaacgaggttggattcacccaatatttgatagtactaaaagaagaagatgaaaattttagaccaccacaaacaatgattcaacaaagtgttttgtatccatcacaattacaaaacatattaaacctattacaaaaactttctcaaaaaattcgacttccagaaaatatccacttttcgcgtaaagttcatgatttgttatttaatccttttgaaatatttctgaacaaatcgttaggtttggatataatctattcaaatccatatttattcccattcaaaatccgactttttgcattcaaattattgactttagaaccgaaaaatgcattcaaaaagttacttaaagaattcaatatcgatcataaactatttaatttaccttcaacagaacaattaaagatacatgtaagtcgagactcattatttacagacgggtgtaggctcttcgaaagatttagtcaaaatttatctaaacttgaagtaatttttaatgatgagccaggaattgggttaggtcctacacgtgaatttttcactttgttttcacatgagctttgtaagacagaacgaaggttattcagaagtgacacgaatgagccgggaatggcatcgtgcaagagcggaatgttcttttcaccgctcatgccgataaaagccgctaaaatctttggcacttttttggcaaaatcaattcaaacagagtacttaattgacatcaacattaatccttgcttgtttaaatttattagaggcgagaatgtaaatgtagaagatgttgaccctatgctggctcagtctttatctcgtcctgagggtttagtcggtttaacatttatttatccaggattagaatttccattaatagaaggaggtgaagacataattgtcgaagaaagtaaccttaacgagtttgtttcactgattagggattatacttgcggtgacaaattaaatgatcttcgagatgcatttttagaaggattttcggaaatattcccattcgaatatttgaagatctttgatgaaaatgaaatatgtaaaatattaagaggcgataattccaaattcacatatgaagatttagaacagaatgttgatgttcttcatggatatcaaaagaactcaccacagattagaatgttgttcgaaataatggttgaaatgacagaagaagaacaacgtttgcttattcaatttattacgggatattcacaattaccaattggagggcttgcagcacttgaaccgaagttaaccattgcgaagaggtcatttgatgatgaaaaaatcgatccaaatgcgcaattaccatctgtgatgacatgtacaaattactttaaagtcccgtcatatacaaccaaggaaataatgaaggaaaagattatgctggcaatacacgaggggttaaactccttccaattatcataataaacgttaatagatatacaaatgtaaaactttatcacaggcggttatgtgaagtgttgtgattcaaaaaattgaatgaatatatcgttttggattcaattgaatgtcaaatttcaatttgttggtgtgcaaaatttgtttcaattgctgcttttgttctatgaaatggaagtagaaaatatgatttttgaaataaagaattcattttttcctgatatatatcaaattattaattaccaatcattttttgataatcatattgatttgcacaattcattttgacacaggcagaaaaaaaaatacctgtattatgatatcattttatcctaacgatattttaaatataattagttttgaaagcactaatatcaagatgatttttctttatcgacaaaaaaaaatttttttctgtcaagaaagtcagcaaaaacgaggattttgatataatttaacagaaattttcaaaacacaactcaattatttatcatagatcctcaaaacttgcccacaatttaatgatgaaaatcagaatgtgtcagcttgaacaaacatcgataattgtacgtgtaattttatactttatcatgtacaggtatatattccttcctgataaaatacaacactattacgcactttatagtgataaattttgtataaatatcaaaaaaattaatcattatattcatgatcactatcaattgaaaaatgtaatcaaaacattcaaccaaaaatgttgttcatcaatgatccatttctataatcaaaaaacattatgtgtttcttctggtgtatgcaaaaatacatataaatcattatgttcaaaaacatcattaattccgaattatgcttgttatatagaggtcaatagatattcaaaaaatattaaaaacaaatatttttatccattttattatcaaaaaatttcatgttctcattttttagatttaaaaactaattttaaatgttttttatatttattagttgtacttaatataatgataaaatttttacttaagatattttctaataatagagaaagaaccaaagcaggaatatcttatgcttatatttttattatcttatttttctttcattctcttcaatcatatgattctgatacaaaaacacttacgataattgatagtagtgattttgaagatgaaaacataaactatgcaataaatgttataattgaaggagaaataactgagatacctcgctcagcattttttcaatgcgaacaattaatttcggttgaaattggtgatttagtttgctcaattggtgactatgcatttcgtttatgttctaaattacgaacaatttcaatagggggaaatttaaatacaatagggaagaatgcatttatgtcatgtacttctttatgcaatattattattccaaattcggttaattcgattggttcaaatgctttttatgattgcacaagccttcagtccattgaagtgtcttctgaaaatgtatattattctaatttcgaaggggatggaatactttataccaaggatctcacaagaattgtatgttatccagcaggaaacgaaaataaattttatgaaaatccaaatacagtaaatattattggatcatattcattccaatattgtcgtttagaaaatcttataatttcatcatctgttacttcgattgaagaatatgcatttcgccattgtaaattattagtatcaataataattccaaattctgtaacaacaatagaaagatatggtttatcttatatatctcctataaaacatattgatattccgaattctataaaaactcttaagaatggtttatttgccagtacttcgatagtaagtgttacgattccaaattcggtatcttcaattgaagacgaggtatttagctattgttcttcattattaaatttaacacttccaaattcaattgaatatattggagaaaatgtttttgaaagttgtacaaaacttcaatttattaaagtttctgatgaaaatttatattattctaattataacaacgattacgtcctttataataaacaatttacttcaatcatttgttatcctgcaggaaacgaaaatgaaatatttgaaattccgaagtcagttacaaaatttaaatgctattcatttgcatgctctaatttaaaaagtatcacaattccaaataatgttaattcgattggagaatatgcatttgaatattgtactagattatcaagggttgatatatcaaattcagtaaatacaatcaaagattttacatttctatcttgttattctttaagaaatgttaaaattccaaattctgtgatttcaattggcttactttcattttttggttgtcgtgaattgcaaagtattataattccagaatctataaccacaattaaatctagtgcctttgattcatgtattaaacttcaatgtatttattacttaggtgaaaatgagccagaaatgttatttgaaaattttcactatgttcctgcaacatgtgttatgacatcatctcaatataaaggtgaaaaatttggcactttaaatgtttcaaaaggtacaacaattgaagaatgtccagagattacatttccgacactcctttttactgaatcaaattcatttaccaaatcaaatacatatactcaatcaaatacatttaccaaatcaaatacatatactgaatcaaatacatttaccaactcaaatacatatactgaatcaaatacatttaccaaatcaaatacatacactgaatcaaatacatttgctcaatcaaatacatatactcaatcaaatacatatactcaatcaaatacatttactcaatcaaatacatttaccaaatcaaatacatatactgaatcaaatacattcacaggttcacttccaccagattcgagattgacaaactttgtaacttttactcattccttaataattactcaaacaataaccattaaaaattcctttttatcaaacactgtttttcttataattaatggttcttcagttacttatattttcacaaagcatattttttatgattatgaagtgataaaatattcgacttattatattttttattcgaatttttattctattattgtaagcagtgatttagaagacaaaagcaacaaattaagtaatgaagctttgataggattaatttgtggtgcaattgctgtggttcttttgattattggaattattatttttgtgataaaacgcagtaaaaataaattagttataagatctaacataagcaataagagttcttcttccagcgaatttgaaattgctgatcaaaatctaaatcaacatgtgattaatgatcatgatcaatggatttgaccttatattaaatttttaatttcaagaatgaaaaattcatatttttttttttagataaatttggattatcacatttttttcatctaaaattgatttaaatttttcgtgttgataaatttattgagattaatatagtttatattattgaaattatcaaatttaaattagtcagattagtatgatattttgactttaaaatattaactttaagtatgtttgaacatatttttcgttggcaaaaagcttggatttacagtcgactcgaattaagtaacttgagttgtttctgtttgccggttatgtcaaactttttcaatcaaggcaaccgtttgcgattcgtttctcactttttgtatgctaattagcacagaattaacataaaccactcgttgataaaagtgtcaatacttcaatataaaaaatattaggtgagattttgcaaaatcgttgtgacaccccgataagtcaaatgtgtgttcgaagtaaatctcgtcactttttatttattagaatttttgtttagtttacttgttatacataatattcattgatatcaaatgaatttaccttttagaagcaaaagaaaaataaaaggcaataataacgaaaacatggaaacattacagtctattgaacaaattatttttgatttaaatgaagaaaatattaatgaatctgtcggtttgattatgaatattttttccaaagaatattcttattcatttaatttagctatttgcagattcttgtattcatattttgtatcaaaagataattataaattatgttttgattttttaaaaatagttcaaacaaaagaaagagaaattatgggcaatacatgtaaatctattatagatatttttatagatcatcttcttatttataaagaaactcaagaatcaagttatattcttgaaaaaatggttgaaaacgaaatgatttgtacagacaaactcaggtacaaaaaattaccatattttgtgtatataaacgatgaaaatgatttatataaaacagattttagtgatttcatatcagaacattatgatgaactatcaaataatgattgggaacttcataaaaaattaattaaagaaggaattaatccaggtgaacttgcgaaaataatccgaaatgatgaaatcgaaagacttcaagaaatatcatcaagagaaaattttgattttaatcaaacaattgaaccatcactttatgaaagatgttcatttattaataataaaaatataacattaattgattatgcagcattttttggagcagttaaatgttttagatattttctattaaatgagtgcaaaacaacaaatacagggaaatatgcagctgcaggtggtaacttagaggtaattcatttatgtgaacaaaatcatttaaaatttggagatgcatgtaaagcgttaattatgcttcatcggaatgatgtatttaattatctttatgaaaacaaattaattgaaattaaatttttagtttcgttagggaaaaaatgtattacaaacaacaactttgaaattttctcatttttagaaagtaaaggaatggaaattgataagtcatttatgattaaggcaattcaaactggtaatttatttcttttaaaatatttacttcaaaaaaagcctactaaaatatatgtttatgagattttgacattttcgggaaatgatgaagttttaaattaccttaaaagcaatagatatattaagtttaagtatgaaaaatgttaataatttttatttatttttatttatatattataattgcatattttatttggaatttattcaaaatatttgaatctgcactatgtaaagcagctggtaagggctacattgatttagtaaaagtaattcttgaacatattggactccacatagctcataaaaaaatttgtttaaaagttttgatatatttattaaaaagttaaaatttgaacttaatatttgttgaagcactattcgaagcagttcaatgtggtagattagatgtagtgaagttaatttttgaaaagaagtatatcgatgttaaaacaagagaaatttctttataatattacctatttatattaattatttgtaatttgtttattaaattattcgtttcaaagtgcgatttgggaattattttaaatatttaaaacaatatttttatgtgcagctcaaataggtaatgctgatttagttaaatatcttcttgataattttcacgatgagattgatatcaactataaagatatttaattatttcatttaaaatatattttaataatattatgtttcaaaataatatttgcaaattattcatatcatttgaaacagcacttataaaagcagctgttactaaagaaggtaatgttcatgtagttaaattacttcttgaacaagaaaatattgatcttaatgctgttgctgtttataaattttattcagaatttattgtaataatttcacattttgaaataatatttgatgactatttgatttatttatgtcagcacttatgctggctgctgaaaaagggaattcgagagtggttcaattacttcttgaacaaaaaaaatgtgatgtaaatattaaaaatatttatttactttacgtataaattatttaaattatttgatgttcaataaaaaaaattggaaattattaaatttttttaaaacagcacttagtttagctgttaaaaatggccattataaagtagttaaattacttcttgatagaaaagatcttgatgttaatgctaaagatatttgtttgtttgatttaaaatttgttttaataatatgatgttttgaaataaaatttggaaattatttatattatttagaacagcgcttatgtttgctattataggtggttataaagatatagttaaattacttattgaacaaaagggaattgatattaatgcaaaagatattcaattattttatttgtaatttgttttgataatatgatatatcaaaataatatttggaaattatttggattatttcgtacagcatttatgtttgcatctgaaagtggtaatttagaaactgttcaattctttcttgaacaaaagggaattgatattaatgcaaaagatattcaattattttatttgatatatgttttgataatttcatatttcaaaataatatttggaaattatttggattatttgaaacagcacttatgtatgcatcagaaaatggtaatttagaaactgttcagttacttcttgaacaaaagggaattgatattaatgcgaaagatatttattcattttatttaggatttatttttatatattggaatttcatattaatatttggaaattatttataatatttaatacagcacttcttttagcaactaaaaatggtcacaaagaaacagttcaattacttcttgagcaagaagaaattgatattaatgcttgtgatatacaattattttattaaatgattaattttataatatggtatttcaatatagtttttaaaaataattctgatcatttaattcagcacttatttctgcagcacaaaatgattacttagaaataattcaaatgcttcttaaaaaagaaggaattaatactaacattcaaaatacgcatttgttctgttgatagttgaacttcgttttttatatttagaaattatataagttatttaatacagcacttttatatgcatctcaaaatggtaatacagaaattgttaaattgcttctcaaacaaaatggaatcgatgttaatattaaaaacattaatttattttatttaaaacttattttaataatttcttattccaaaataatatttggaaattatttgaaatattttggacagcaattatgatggcttctaaaaatggttatattgaaatagtgaaattacttcttgaaaaaaaaggaattgatatcactgttaaaggtatttgtttaattcatattatatttttattaataatttgatatttcaaaataatacttggaaattatttaaattatttaatacagcacttctcttggcaactaaaaatgggcacacagatatcgctcaattacttgaaaaccaataaattgattttaccaaactaaatataaccaaattaaacacaaactgttgaaataattattctccgatttttgtagtgagcattttgttttttaagattaccaacggctaaaaaaatatttgcaaaaattaatgaaaaattgatttttattcaaacatcagtaataaaattacttcttgtcattcaaatatttttccttttattgtgaaatttaaaagtttctatccatttactaccggctaatgaatttgaatcattttcttcaatatcattacgggaaaaatattttctggttgatttaattcctttggtaatgcgaactgctgagaataaccgagctcgggggttacttcctccataatcattgctaagaacatcatcattttcttccaatgatgcttctgaataagtgtcttttaaaaatgatgtataatcttggggtatacttgtttggacgaatcaacggatacaacaggttttgataataaaaaagtatcagtagaatcaaatttatcgtgtttaagtttgatgttagggtttcttaagaggcaccacgcgaagcaaaaaatcattgtttaagggtgtgataatattatgactatgaaaattgttgtcattttgacaaatttgagaatgttcaattcaatcaagaagttcaaattttgaaagaagggagctttttcagaagtgttctcatgagaaacgatgaactaaaccacaagaatgttgaaaatgtgacttgaaacaacactttgtttgacgaattttatctccttcatttccccgttttatgttaatatactttacgaagtaaaaaagaaaaaaaaatcacagttcctgcatgtaaacaattttttcctttcaatttgaattggatttggaatactatttaaactaatatatgattattgagcatctctcttaatcacaagaaataccttttactgattgagtaataataataaattttggtgaaggagttaatcaaattgatttcttttgagttttattctttaaaatgatttatagaaagtaaaaaattggggatgatccaagtgcttatacttgattagatattgctctaatcgaataaaaacgaattcagagaactccacatgcagaaatcagttatcatcgacactttatcctctatatgttgacatattgagttatatgaaaaccttattgagggtgtgactaattttaaaaaacattatttttcgcaagatttgttggatggtgacactttttatcgttatatattcaaaaaatggcattgtttaaaaaagtgctacgtgtggccactttagctggcatgagtaacaacaacgaaattgcaatggaattcatttctgcatattacaataagcttgcgtatgcaccaaatgatttaccaaagttttacaatcaggaaaaagctataatatggcgtcaatctatggaatcaccaaatggtattccttttatagatgccaaaaaggatttgactcctcacatagctagagggagcaaaatcagtgtgatggattataacatcttaaatgttggaagtggctttattttgaatgtttttggaaaaattgaaagtgaaataacacataaatttgtccaaacatttttcattgaaactgttgaaggagacgattcatcaagaacttgtgtaatttctgattcattcaagtatgacttaagcaatgaagaagaagaagctcttcaactcactgaaattccacaacctaaaaggcaatataaacgaaagaaaaacaacaataagttcgtttataaatctgattaaatagtatgtcgcccaaaatttaatatttcttttataaatggaatgtcagcaaaccgagtgtgtattttgtattggtttttattatttttgcactgtgtgcaaaaaaaccttaatttagaaaaaatatttttttccaacgatagaatcgaatgaatgaaaaatcatcggatttatattcaaaaactgaagtgtttgggatgcttaaacttagaacataaaaatgggaaaaaaatattaaaaaattctaaattttacaaaaacaatttcatttttttaaagcaattaaactttgtgaaagggtattcaatccaaacttcccattatcttccaggtcaacttcattcatttcgatgcaataatttttcattttttgtatcatttcgtgttcatcattacttatttgaaatggtatatcgataccatacattacgaaagctcttatcaagaatccccttaaatacaacgggaactttagtatgattattgggtcatattttttaacaattgtttccatctcaatgaagactgtatttccattttttaatctattaatagaatcttctaattcttcatttgaaatatcttttaacaaaattgtttcatcttttatgtcagaacccaaaagaaaacttggcttattaacgaaatcaggatgatatctatcaagagatgcattaatttcatccaattgttgttgacttatatctgtttctgaatgatttacatactcttgaagtttatttaatattaaatttaatcttgaatctgtagaaatacttattactaaagcaattgatttaattaatatgtccgatggaattaaatcaaatatataattagttaaaagttgtattgactcggcagcattaaatgaattctctccttcaagtaattgatccccacttaaaatagaaaaacaaatatttaatatttcacttatcatatcaatcggaaattcttcacataatgaaagaacaatcattaaacactttgatcctttttcaaatattgtcgaaacatttggataaatttgcatgatatgaataacattatatataaattcaagtacatttgatggtggttcaccattttcaaacatttcttcagatcggattaaaaaatttattgcaccgtcagaagtttcttcttcgtttggtggttcttgttgaatcatttcaggatttaacttggaaagaacatcaatgcagagagatttaattccatcatcatgatgcattgagcctgtttgaacacgttcaaaaatattttgatcaagttctgataaaagtttaaggatatcaactgataaattatgtattatttcattcgtatttccttgcttaatagttatggcaaaaagaatactaaactcatctggtcgtgatggaatcccaagattaagtaacgtttttaataacgttaacgagtgtactttattatcatcatctccaacaattataatgaacccaaagtataaaagtaaaaaatctgttattgccaaaatttgtgattttcgtattctcatcattcgtttgatttgttggaaaggatgcgacaaattcaagcttgcttgagtgtttgcaaagaaatttggtggatttgtcactctttgattatctaatcgagattgtggaatccttgattttctattattatacgtagtaataagataattgtatagttgagaaagtgatttaggaaacaaagatgaaaaaaattgtggagtaaacaataactttcctacatttttaatatgattgaaaagtatttcaacttgttcggaatttcctattatacgaggcttcccgataagtttttgcggaattttccgagcatcaagcatttgttgggttggtgtaattttaaaaattggtgtgggagatttcaataattttccattcgtaaaattagctattattggtgatgtaaatatgttcttttcacttggtcgtaaaggtgatcttttttgtttaattgttttttctggattcattttagtttgcgatggtaaactttagataaaaaataaaaaaagagcaccgggaagactcgaacttccaaccttgaggttatgagcctcacgaactaaaccaattgttccacggtgctttgacgtttcttaaaacaacgtatagtttgtattatatatttataaagaagttttgtactttttgttaattttacagtttattttataaaataatggggaacttgggaagtcaaacgaaattcagcaaaaatcttcaaatattgaacaccatagagcacattatttttgacttaaataatgataatattattgcttcagttgaattaatcttaaaatattttaatgaaaaatattcatattcatttaatttcattatttgctcaactttattttcatattttgtttcacaaggtcattatcaaatatgtttggaatatttaagagcgcttgaattaaaagaaaatgaaatttataataatttacataataacgtaataaatgttttcatatcatatttaaatcatacatattatacacaagagtcaaactatctttatggaaaaatgattgaacaggaaattattcaacccaaaattttaggaaataaaagaaatctatatttcgcacattatctttcagaagaagaatataaaaaaattgaagatattaaaccttatcaaaattttaatgaaaacattaaagaattaaaaaagaatgattgggaacttcataagaaatatgttaaagaaggagttaatcccaataaaattgcgaaaataatccgaaatgatgaattcgaaaaacttcaagaaatatcatcacaaacaaattttgattttaatcaaacaattgaaccatcactttatgaaagatattcatttattaatcaaaataatgttacattaattgattatgcagcatttttttcatcagttcaatgttttaaatatttactcatgaatggtgcaaaagtagaaaatacaggtaaatatgcagttgcaggtggaaatgaagaaatcattcatttatgtgaacaacatcattcatcatttaaagatgcatataaagcagcaattgaatttcatagaaatgaaatcttttattatctttatgaaaataaaatagaaaaaatcaacaatttaggagagttaggaaatatatgtgtttcatattataattatgaaattttatcatttcttgaaagagaatggatgaaagttaataaagttttgatcattaaatctatagaaacaggaaatacatttttggctcaatattttcatgaaaaaaatctgatttctataaatttttttgaaacttcaataatttttgaaaataaagaactgtttgactatttgattaaagaaaatattataaatattcacggcaaaagtgtttctataattaattgaatgtttatttgattgttaatctgtttgacttttttttatggaaattatttaatttatttgatacagcacttatattggcatccaaaaatgatcatgcggaaataattaaattacttcttgaacaagaaggaattgatgttaatgctaaagatatttatttattttgtttaaaatttaatttaataatttgatatttcaaaataatatttggaaattgtttgaactatttaatacggcacttatattggcatccaaaaatgataatacggaattggttaaattacttcttgaacaagaaggaattgatgttaatgctaaagatattaatgtgttttgtttaaaattcattttaataatttgatatttcaaaataatatttggaaattgtttggatattttagaacagtacttacgtttgcatcaaggaatggaaataatgaaatagttaaattacttcttgaacaagaaggaattgatactaatgtgaaagatatttatatgttttaattaatatttatttttattatttggtatttcaaaattatatttggaaattatcgattttgtttgatatagcacttataaaagcatctgagaaaggtcatatagaaattgttaaattacttttattacaaaaaagaatgaatattaatgctaaagataaataattactttatttaatttttatttaaatatatttggtaattatatacaatatttaatacggcacttatattggcatcttctaatggtcatacagaaatagttaaattacttcttgaacaagaaggaattgatattaatgctaaagatatttttttgttttatttaatatttttataaataatattatatttctaaataatatttggaaattacataaaatatttaatacatcttttttaaaagcatctgaaaaaggtcatatagaaatagttaaattgtttttattacaaaaaagaaatattaacattaatgcacaagatgtttacttgttgtatttaatatttgtttaagtaattttatatttcaaaataacatttgggaataatctaaattatttaatacagcatttataaaagcatctgaatatggtcatttagaagtaattaaaatacttcttgaacaaaaagacattgatattaacgcaaaagatatttatttattttattatatatttattttattaatttaatatttattttaataattttatatgtcaaaataatatttagaaattattttaattatttaggacagcactaataaaagcatcacaaaatggtcatacagaaatagttaaaatacttcttcaacaaaaagatattaatattagtataaaagatatttaaatgccttataaaaaatttatatttataatttaatattattaaatataatttggaaataatttaaattatttagaacagcacttatttgggcatctgaaaatgaacatacagaaatagttaaattacttcttcaacaagaaggaattgatattaatactaaagatattttcttcttttatttatatttcattttaataattttggatttcaaaataatatttggaagttattcgaattatttaatacggctcttatattggcatcttctaatggtaatacggaaatagttaaattacttctcgaacaagaaggaattgatattaagactataaatatttgttcgttttatttaatatttttataaataatttgatgtttcaaaataatggttggaagttatttaaaatatttaaaacagcacttaatttagcatctaataaaccagaaatattagaattacttaataaaaaaatgtctaaataaatataaattattaacaacaactcttgtaagtttaaaatggttatttagaaataattaaattactttttgaacaagaaggaattgataatgctaaaagaatttatttgttttatttgatatttattttaataatttattgattaaattatgcttccaggaattgtaatgatgaaatagtttctataatcaaagaaaagaatggactgaatttaaaggaataaatatgaaagcaattcagtaaccattaataaatgagaaagaaaaatattagacgctgattcatatgattctaatatttgatgacttaatgttaataaaaaaaattcattttagaaaatttttatttcctaaaaaatatttagaatgcaacgatggttaaatgcattatcgattaaatcaatcataatatttgttgtctatgaatatatatagcattatcatatgcagctaaaagaggaaaatataaacttatgcaaccacttcttcaacatgaaggaattgatgtcaattcaaaggatatttatttgtttaatttaaaattcatataaataatttaaggtttcaaaataatatttggaaattttttttagtatttaattctgcactatattgggcaacaaaaagaattttgctgaaattattaaattacttcttgaacataaggatttttaaattaattttaacattaatgttcaaaatatttggttgaattattgaatatttgtttattttggagtttactgtattaaaagcgtttcgaacatcattttatgaagatataaaacaattatttattatgaaaggccgaatcgatttcaatattcaagatattaaatttattttatgtttctaaataaaatatgaaatttattcaaaatatttaaaacagtaaaagatgagatgaatgaggatataaaaaatcaatgaactatttagtgggtaaacaattttaacacatctttttcattttaattcattttatgagatgagattattattatactcaaaaaatgatcaaatggttaaagtcatataaaataggaatttaacttgttttactctgttggagcggcttcagctggtgcttcagctgtttcttccttcttatcttctgatctacggttacggaaattgccacgtcctggacggctgaaattaccgcgtggtccacggccaccacgtgctgctgggcgttcagctctaaggaagtcagccttacgtggagcaagtgttaatggggctgcttgtggtgggagaccgaaatatttacggagatattcaatacctttgtcatttaatgtatagtaagcgtgggtccatgcgtattgctttttagcgaatcccttgttaacaaatgaacggccaagttggaaaacatagatgttaagaacttcaagttcttcatgaattccagcattgtttgctgaaacaacaataacaccattttcaaagaagtagcggaggatcttcctgcggatgtcggctggaatgaacatttaccaagaaaggtggaccataaccgttaaccgcacaaaaggaattggaccaaacgatcaaatgcgattcaatcgacgattatgcaattttagcaagtggttgaatcttaacttgcaagttttcattttttgaatcatacctcttttttgtttgatttgcaagtgaaaatcggtacgacttaataactgagagcaagacttacacactcgaaaaaattaaaattaaggctttttgaatatttttgatcggtaacctaaacaaatcttggaaagctttcaaagaaataagaaaaaaaatgagtactcaaatgataacatgttttaccaaaaattatgcatattcattaaacttattttcaatccaatcgacccattcgtgtgactgtggatcctctgcatcagcatcctcaagaatttgttgtactggaatttgtgaaattgatattccttccattgaggtgcatcctttttgctgaacaaggtattgtttaaccgcaaatgaaagttcccatataaatctgtcttgaacttccagaatttgttctttcaaatcatttagaaattgtttctttttttcgttttctgttttaagttcttcattttctgctatattctgatcttttaatgcccgttctaatctcattgatgtttcttttgtaagttcaatatcatttttaactcgttcttgaatttccaaaaattcaacatcattacttgctattgaagatcttggtgtatacctttgatttgaagctattgatagtcttcttctatttgaagaatagttcgctaaaagaggttgatttgaaacagacataaaaaaaataaaaatttaacgtacatttttttatacgttaaaattgtttacttaaaacgttagacataacgtgtctcatctcacaaaaataactactttttaattgaacgataatcaattcatcgatgacaagatctccaaggagtgtacactcagtggctaatcctttgattccaatgatgcctgaaaatagagattttgatgatcttcaatatatggaattagttagtactactccgaattcagcaccaaatgcaactttccttagaaagccaacagaaaactgtttagatcatgaactttatcttaacacggatatgtcagcaactcatgatatccgttttataattaatcttaaaaaacatcaagaaaaaattgattattgtatatctcaatattattcacgaaggtcaattatggggcctcttaagtcctatcttcaaacgcataaaataagtgaacccaagaaattttgtcaaatctcacatgaatatcttaaacctcttcttcaatttttgtccaattctattgattctgttaaacgctccatcaatgaaattcacacaatttttactaccacttcagtttggtccgttgaacttcttgataatatatttcttcttatttacaaattgttttgtttcgacacacttcgcggtgctaaaaagcaaatcctttttgattttgaagaacttgataaacaatattctgatcatcttcatgtaaataatgttgttgatctttccatcaagttatggcttaaacaactttcaccaattattgacgaactatcaagtaaaatgaaaacgattccacaagataagttaacatcaattctttcgattgtttataaccacttgaaaacatcacttcaaaaaacgccactttttttcgaaacacgttattcacatttagtttcacttgccttttttaagcgaattttcccatcaattataccttctgcagatttagggttaataaaaagctttttccaacgtacgccatgtgttcctttagtacatgaattttcatataatataatgaattatatgtttggctccattaataataatcaaatttatgttgttgatcttaatcaattacatgatgatttacgtaagaaatttttagatgttttatcacgtttacaaacagaaatacgacaaaaagtccaaaatcgttcacatgaaacaatagtatcgattacagctgaagcaattaaacttatttcatcgacaacaaatattattcgtgaacaatattcatcaagaatacaaaatcctccacttgaacctaaaacaatgaaaccatatgaacgatcagtacgaacaggatttacacaattagaacttaaagcaattttacaattacttgcgttatgtcgagagcttcatgattacattcgttataatattccatcgatatatcaaaaactttgttcatcattacaattaacatttcaagaattcattaagaattcacttgaaaaagtcacaaatagaattaaaaagaataaacaattcttatgtaaaataataacacaaattcgaacattcgctggtgattggcaacaaaatgaagaaatgttatttaagaaaaacgaaactaagaaacatgaaatacatgttcgaacggcagcaccatcaccacaattaattgaatttgtacgaatccaattacaacatttattaaattcgatattatatccttcatcatcatcatcatcatcatcttcgtcatcatcatcacaaaacgcgaaaaataaaagaaataatcatgcatggattgatgaatgtgcgaagacaattgaagatttcttagagataagtgagaattggattgatttattagatttagatcaaacgttaattgttgcatcaaatcaaagttcattttactttaaagaagtacaattagatcttaatcaagaggtacaatttccagtccgtgcatcattaccatttatattatgtgaatttgcattagataattatgatcaaccagatatcactgatattatcttttatccattatctatttatgatgatgcagcatatattgctatccataaattaaattcacaattaatatttaatgaaatatgtgcagaagctaatgtttgtttggatacattatcagtattaattggggaatttacatttaatgcatttaaaacttttgcaacattacatcaaatacctgattcaatgaaagaacatttaaagaaaaatcatttaagacattggcctaaatcacaagcttatcgattacgaacattattacaacaaaatcaatataatttattatctaaacaagttgctttagaaacattaatctcttcaagagttgatcaagaattaaataattttgttgatcgtttatttggtattggtaaaactttaggtttatcatcatcattagttattaaacatatgattaatattatacgacaaacacataatatgatgacagaacaaggattaccattaatgccaatcaatgatataattcgtgcatctaaagatgaaagtatccgaatatttatatcacaatattttaaagatgttgttcaacatatgttacataatgttattcctaagtttatattattaataaatccaatgagattaataccacctaagaaacaacaactttccgctgatttattaggtaaattaggtttaggtaaaatattaaaagaagcattagaaccaacaattacatttatatctgtgaatcattttaatacatttattaaagatatatcaagtggtgaaattatgttattagatcaaatgattaaacaacaaataccaaaattatttaataattttgtaactaaatatgaaattattaaatcgaaacttacaagaattaaagatcctccatttggtactcatacgcaatcagctttttcacgatatgaaaatgcatataaattcttatttaatgatttagatttcattaagttactaagttcaatgcaaagaattggtaatatatttgcaatatcgttaatgattgatcaagctttagcaatggacatatatgaaactcaacaattaactaattatttaacaaacgtcgatgaaaatggtcgacaatttaatgaaatcgaaaaacttttcgatactgaacaacaaaacgcaatgaaaatattattaagtcgaccgaaattcgatgaaagttatgattatatattcttaagaatggtatctgatctattaatgttaggttattcatacgaaaaagaattgttcgaagaaaatggtaacgatatgaaaggattcgcttcgatttggtcgataatagaattcgtatattgtttgatggaagcaaatagagactcaaatgaaattaatggattcgctaaatatggtcacggagtattcgtgttcgctgctttggttttggcaatgacaaaccaagaaaagttatataaattgttcggaatttgtaggaaaattcaaagatataaacaaagcgatataacaacaagtaacgaaaagattttggagtttttggcagtagcaaaatatggaacatcagctgtggaatgggctgtgacttattttgggaatttgatgaaaacacaaaatattaatgtcgaaagtaatagttgacgttgagtagaaaagaatttttattctattgtttaatatttataaaaaatatttcgaacttatactttttgtttcatttcaaagtaataatttcactgaataattacgtaattattaattatgtaatgaagtatttgcgataaaattttttcatacttttgcaaatttacgaaaacaaaattcaaattctatgtttataaaagttcagagagtttttttgaactgattcatcaatagaatttccaaatgtggatctttgatgtgttaatgctgcttttgagatgagatctgcaagtccaaaatttgctaatttgatccgactgtgttaagcaataatatagatctgtgttaacacgttgctgggatatggtcatgagggctattaacttcttcagaagaatctgtttacgttgcttttcaagtcgtctttatattcgctcggcaaagatctgttgaaaaatttaataacttttgaaaatgagaccaccaaagatttctcgagttggagcaagacaaaaattattacttgtcgatttgaattttaggctgaagaaggaaaattctatgggattagtgccactaaactatagtataatttaattaagtttgattttttaataatgctgttatactaataactttagttttgtcattatgtgagtaatatcgaatatttaataaaatcaatatcaatgaaaaagtggcatatatcacaatttcaattcacatgtcaaataattgttaaaaaatggaagaaaatatcgtgatcaaagccaactttttttacgttacccgcgaaagtcaaagcgagtacacaaagactaaatggcagccatatcaaaagtacacagcaaccaaaattttagaaacatttaagaaaaaaccattatttattgacaatcaagaaataaattcagttattttccatagcccaacattcagcttctgtctcccaccaaatgtagaaccactatcaatttttcctcaattaaaatatgaacttgaaatgagaccacattttgaagctcctcctcaagatccgacttctgttccaacagagcctaatccaccagaaggaaaaccaatccaacaacctcaaccagaaaaccccacaccagaattagatgaaacaatggataataaagctgtacttagtttaatagatccgagttccaaatacagcaaaagtattatgatcaattttgctcattcagagaaaaaatatgaaacttttgttatcaaaattccaatatctaatatcgattatgatggaaccaacttaaaagaattcattataaatgcagtcggagatcaaacatttgaaaaatcacttacacagtttgctaaaacattaaatgttccaccagaattaattcttcttaaacaaattgtcaatgacgaagagcattttctcttccctaacaccaaagttgctgaccttatggaacatttatttacatcagatggtgtttttagtccacatgaattatcatatgatgtatttgtcactcctgaattacaaaagccaacattaccagctcgtgaccaatatgtagctagcgtagaagcattttgtcatgaccttttaagtattcttaaatattccaaaccgtcagaatttattccaattaccatcaaaaatctccaaggatttatacgcaaaacttctattcccctttcagagaatcaaaaggagattcttaaagatgcactttcccaaattcttccatcaataataattgattacttatcaccatatttcaacagtaagatcagcggattgaaatggtctgacctcaagaacattgccaccaaagaaaatgcgcatcccaattatattaaggaagattcgaatactgaattgctaattgcgatacatatctcacgatggaccacatttccgagcgatgtcattgaacgtgttcattcatcagaagttgttttttctaagttgatgccgatgcaaaacattaattattatggctacattgtatatagtgattttatctcattacaaacaggaaaatactttttaatattaacacgtggctttgttaacttaatgaactttgcgccacgtaaagaagattcagcgcatgaagtattaccattaacgtatagttttaattgtggtattataaatccattattttatggtgctccaatacaatgtgtaaagtttgtacaattcgaattcgataaacctataggtgtcttatttacaccgaaaggaacattaacaattgactttaatactttcgaatcattacatgacttttggttaatgttaaatatctgtcaaaacaatttggagtcatcaattatcgaaccaccaatacctaacttaaagatcattatatcatttccttgtataggtaatgaatataactttaatgcgaatattgaagcgggacctgaaaattggaaaatttgtgaacctataaaacgtattatcgagaaattcgataaaatttatgcaaataatcgaaaggttaaaactatggtctcacatgaaaacccaattgttgaattaaagtttcctaaagaagatgaacatattaaatatttaaattgttcatattctaaggtcaaaatctctgaatatattaatgttccatcgtatgatgattatcaagaattattattaatatatattaaatccacattaattgaacttgcatgttcaacaaatcgtgcgtatcaattcaagttatttaattatcttaagatcagtgattttaatttctcatttgagattaattctgccgaattattacaattccaattaaaacattttggttcattattaaatacatataaaaaacgttcatcgccattattacattttatatcattattcactgataacttagagttccttaagatgatcataaacaaaaaagatataaacaaaagagatggcgatggacgaacagcattattttattcattacgtaatccatccacatcgatcacacaaactttaatcgaaaatgatattgatgtagatttaggtgataaacaaagtgaaacatgtttaactaaatcaatcgaaattggacttccagagaagacaaacttcttagcgagtaatggctcttccattaatcaaacgttaaaggacttacatcaatcggcattaatcttctctattaaatgtgggtattatgacatcttcgaaaaacttttaacattttgtgattcgtcatacttaaactatccaacgtctgatgaagaatatcttacacatatcttaatcaagtacaaacttgaagatcaattatatctattagcaaaacgttgtccagactttaatccaaatcgttatactgataaattacctcatccattacattatttctttgatagtggaaataatgaaacttatgatccagacttatttaaggcgttgttatctttaccaaacttaaacttaaatgtaagaaatgcaatcggacaaacgccgttaagtagatgcgtaaaatcaaacgcaatttcaatattaaaacatttggtagaagacccaagatgtgatctcgatttacaagatgaaaatcatcagtcatgtttatacatagctgtaagtcaaagatcaaaagaagctgtggaattgttggtgaagaacggagcgttgggaaacgcaccgaataatgataacgaaagaaatacgccgctgtcgttggcagtgaaaaacggtgacgaagaaatagtgaaagttttgttgcaatatggcgctgacccaaataaatggtataatagagaaggtaaactaccaacacatcttgcatcaaaggaaatgttggagatgtttaaacaaaaacaaatgttgaacagagttttcccagtaagagaaccagaataaatttgcgaaataaaaaattcgaattttttttcttttttaaaaaatttgtgttaaattaaaaatactttacgcgtttcatggcgaaaaaagagattattaaaataacacttcaataagaaagaaaattgctgaaaagatttgatgatctcttcgttaaaaaattttaaaatcgggatttctaatgcaagcttaaaaaattgtatatactatgaaaatggtatgtgcacaaagatacaacaatgtggtcagcaaaaaagtttttagggaagaaaagatccctagatgaaacgatacgaatttcaaaatgacgataatgtttttctgattattgaatttgtctatcgctttattttcacttttttaatggttatttggtttccaagttacagaagatgctgagttgtggtttgttgagaagaaaatttaatttaaaatctggcgttttgggtcctttagaaacaaactgctatttgttggatttcaatggtaaatgtttggttattgaccctggagctatatctgatgacgtaaataattggattaaggaaaaatctaaagtagaaccaccaaatatatatttgacgcatggtcattttgatcatattggaggagttagaagtatattagaagagttccctgaaacaaaggtttatatttcaaaaaatgatttggaatttttaacaaatccaagattaaacctgtctgaaaatatgggatttgaagtggatcttaaggatttcataaaaaatttgaactttattaagcatggtcaagaattaaaatttggtgatgaatcattaaaggttttagaccttccaggacatactcctggaggaacagggttatactcttccaaggaaaaaatggtttttgttggtgatactcttttccaatcatcaattggaagaactgacttcccaaaatctaatttcaaaagtttaatgaaaggcataatggaacatttaatggctcttccagatgatactcttgtgcttcctggtcatggcccaacgacgacgattggtaaagaaagatcatcaaacatgttcatccaaacagaaatcatcaaagcacaacgaaaattataaataaattaaaacttttgatacctaatttatacagcatgttgtgtaacaaaaaaacaaagtacatatgtaaatctccatctaaatttacagaatctattcacaaaagataattcaatcagccgataatttaaacttgttttgtagaaaataagttcgacaattttgtatatattgttaatttagtcaaggcatttaaagaaagatgtgttactgcaaagcagaagaaaaatatgaaaatgaaaagtgactatttacaatgggagaaagcgttgcttggccaaaccaaatcaaagcagtaatttttgataacgatggcgttattcttgatacccttcctctttactacgaagctttggctcgaattgttccacctccatttgaacaaagtttgattgatcgagtgaacggaaggtcagatatggaagctagcaaaatatttattgaacattttcatctcgatatgactccagaagaattatgtgaaaaaagatttaaaattcttcaggaactattcccaacttcaaaacttgtaccaggagttgacaaaattatcagagcaatccacgaaaaacacattcctcttgcagttgctacaagttctgaaagatcactccatgaaaccaaaacatccaattacaaagatttatactcattatttgatgtaacaatttgtggaaatgatgtaactgctgcaaaaccatcgcccgaaatatttcaagttgcaagtaaaagattaggcaattatcaaccagaaaatgttctcgtatttgaagactctttccatggaataaaggctgctaacactgctggaatggcaacttgcttcatacatccaccatttgaagatgcagaacgtgaatttaaagaaaaaggcatcaatccaagttatcagatttcttcatttaatgaatttgatttcaacaaatttatttggtaaatagtattaaatttagcaatgataaagaaaaaatcttttttaatatatgcttagaatttcaattattttttgaaacaaatgtaaaatatgagtggcaatggatatgtgccaaggacagttttaaaaaacttatcataaagacttaatttaaaataatttgaaaagttttgcaaaatgtttaaaattcaatattgacaatgacgttagattttacggtcaaaattttcacaaccggttttgggtccagaaataaaaaattgacgttcagtattttcaatagaagattttattgttcagaaaaacttattataaccctttttaaaaccgcttaagattgagaactctgcacaaaacgaatttggacaagacagaagaagatatcattgctttttggattcagcaacttacgaattcatatcaaaagcctgcccttgttttggcccttgaccatgtaatggtgaggcaaacgcaaattcatacaagtaaaacagatttctatattacaagcaaaagaaaggttttcatagaagaaagaccaaaaatggcaacatttctggaaagcatttcgatgtattatacaatttatttttttacttcccaagaaagagatgttgcaatgaagattatccacaaaatcgcaccatttgtttcagaaaaaaattgcttttgtagggataattgtatgttcaaatggggatatacaataaaagatctaagaagaataggtatgccattggaaagagttgtaatggttgattcttccattggatctgctcttttacagccaatgaattgtattggaataacttcatgggatggaggagataatgaccatgtattaatggatgaactttatccattgcttgttgaaatacagcaaaaagatgacattgttcttgccttaagaaaacgcatcaatacttattcccaaaacatttacggctacaattgaataaataatgattttcatggaaatttcctatttacttattttgagatttttacatagaatttaacaattgtatcttaagatataacacttgagtaattgaaatttctgtccgaaaaaataaaatacgttagagcgttaacaccacttttatgatttcaaaccaaacaagaattggaccgtatattctttctgaagttattggaagagggtctttttccattgttaggcttgctgtcaatgaaattaataataaaacatatagttgtaaaataattcaaaaaagttctattaaaaatccgaaccattacaaacgttttcaactcgaaatacgcacaaaccagcaaatacatcatccaggtattgttaaaattttggatgtgttagctgattcaaactcatattttataatcatggaatactgttctaaaggcaatctattaagctacgtagtaaagaaaaaacgattaaaagaagatgaagcaagaattttttcttaccaattattaagcactcttcaatttattcattcacaaggaatttgtcatcgagacctcaaaccagaaaacattttaatagacgaaaacaatgatatcagaatctcagattttggactatcaaattttgtagataaaaacggttttacatccacacctgttggctcaccattttatgcatcaccagagtgtcttagtggttttcggtacaatgggtgtaaaagtgatatatggagttgtggagtcattatgtttgcaatgttgaccggaaaaatgccttggaaaagcagaattatttcacaggtgataggtcaaatacgaagaggccaatatgaaattcctacatacttaagtaaagaatgcagacagctcatcaaagggctgatgactgtaaacctttcaaaaaggctgacgataccagaagcactccaaatgagttggttccaagggaaagaacttagagaaataccaataagaatatcacaagatctttcacttcgaagggttgatagattcttctattcagaagaaggagaaatttcttggaaaaaacctcaaattcgcgaatttagttccgaacatataattttcgatgctgtcatcaaacagattgcaaacaaagcaacaaatatcaaatttagtcacagaaaaaacttatctaataatgcgtaatgtgtaaatgtaatatatctttttatttgtatgaaatataaaaatgtttttatatgcttatattttaattaccttcttgtccaaattcttttgtccattcttcaaatctaataagatcttttggtgagactgatgggcgcactttctgaatacttccacgaaaatcatcaattgttaatgcaggtggcttaatcattgaaagttgctcatttgtcatttcaagtacagtgatatgaatcgaattcggtgtacctggattacaaggataaagttgtccttgatattcaacaaagttttctgcttgttgtatacggtttacaggcgccattgctgcatcacgtgcaagaatattcatgtctgcacctgaataaccttcagtcatccttgcaacttcttgtatatcttcatctgtaagttcagatggagtatcttttgttttaagacgaacaagtgcaagtcgtgcttcataatctgggagtggaatataaatctttttctcaaatcgccttcttactgctgcatcaattccccatggaatatttgtagcggcaagaataagaattccatccatagacttacctactccatccatttgaataagaaattccgttttaatcctacgcgctccttcagaatcattctctgttcgttctgaaagaagtgaatcaatttcatcaataaatacgattgcaggtttcttctcgcgtgcggtatcgaataatgctcgaataagtttttccgattcaccaacccatttagatacaagatcagatgtggaaacagttaaaaaagttgaattattggcttctgttgctgttgcttttgctataaatgatttaccagtccctggaggaccataaagaagaataccacgccatggagcacgttgcccagtaaagaactgtggaagttttaatggcagtatgactgcttggacaaggtttcttttagcttcggctaaacctgctacatcatcccatttaatattaggtttttcaacaagaatagcactagatatacgatctttgaattctccactttcatcatcttttttattactattagtcccaccatttgaggaactaccaccattaccatatttacctctgctacttggccttgaatttaatgtggagccacttgaacattcaatagttggagtaacttgaatattatcaagtgcacttgcacgctcttcacattgtttcatacgttgaatacagcaatctttaacatttgggtttaatgttggttgatctgaagccaatttgaattttactttagcactattataatattgcttagcttgggtataatttcctgagcgatcaaatgctattgcgctttgtaaaagcctgttagcttcagtcatatacatcattccgttgtctcttcgattatacatctttttagtagagctaatttttcaattattttaaaactttgattttctaaaaatttcatataataagaatcaaaaatttttaactatacacaaagatttaatacttattttattaaaccattacagatttaaaataaattataattcataaagagttaaaaacgatatttgtaaatcataaaatgagttttgaaagatcttattttcatttaaataattttattcaactctttgcttaaatgctcataagtacaaaaaacatatgtattaaaaataaccttattttttttaaacatttgattaaaacttataacaatttttaatgtttttaatttccaattttccttggtgacggaggacgtttattttacaaggcgagggcttcaacccttcattcatgaattacaagagaaatataaaaattctctttatcatattcgccttgttgcttttgttttatggaatcaattatattttagtgttcattaagtacgtaaaatttggaaaaagaggaaatctgaaaaaataccaggatgaaatccgcaaagttatgaaagagtcatgggacgcttactgtaaatatgcatggggatatgattttttaggtcctcaatcacaagaaggaattaattggtttggagcaagttatacaataattgactcactagattctctgataattatgggtttagatgatgaactaaggaaagcacgtgattggatcaattcttcattacaattaaattccaaagtttctctttttgaaacagttgttcgttgtgttggaggcctccttacagcatacgagcagacaggcgataaagttttcttagacgctgcaaaaaaatttggagactcattacttccagcattcaatacacaaactggaattccacgtgttcttataaatctcaaaactggtgaatcagatgattattcctggtgtaaagaaagcacaattcttgctgatgcaggcacatgtcaaattgaatttttagatctcagcattcacacaggtgatccaaaatatttcaatgctgccatgaaagcacgaaattctcttcttcttcttggtcctgttccacccactatgatagatcatgactatctttttccaacacgagaagagtattcatttgatgcatatggtgattcatattttgaatatcttattaagctcaaatacttttcaccaagcaatgaaaccaaccaaaatgagtttaatcttgcaatgcaagaaggtatttcgcgtctcggatttacatcacgcaagacgtcactcaattatttagcaaggtctgtcaatggtgaaatgttacatgaaatatcgcatctatcgttcttcttaccaggaacgttatatcttgcatcacttattgagcatgaatataaagaactttaccttaagctagctaatgaacttcttgatacagctgtatttttatataatatgcaaccaacaggacttggaggagaatcagcacgatttttaagtcattatccaaatgttatttggtatgatgacacatataaattaaggccagaacttgttgaatcattgttttattgttggagagttacacataatgtaaaagctcgaattcaagcatggaaaatattcgaatcgataaagaagtattgtgatacaggaagtggatactcaacagtaaaagatacatcaaaacaagttgtgatgtatgaggatgtacaggactcgttctttttatcagagacactgaaatatttgtatctgatattttgtgatgacgatacattttctttggatgattatgtatttacaacggaagcacatccattgaagagagtgcgatcatgatcatatttatatgtatatgaataaaagttgttttgtgtatttaaactcgaataaaaatttttatttaagtaaaaaattgttgaaatttaaaagtttattataaaaataaatcgaattttttttacattctatctttataattgatggtattatcttctagaaaatctttagcaaatggatctgcttcaatgttggaaaaatcagcaacaaaattgttattaccttcaatttcagattgttggatagcactgtttgagttctcatgatttttgttcttaattcgtgttaatataataataactataataaaaattattataactataactacgcttacaataataatattgataaatatggttttggaacctttatcatgattttcagttgttttagtataagttaagaaatttgaataaggaaattgtgaaaaatattttaaaatggtatattcataatacatatattgtgtatatgaaataataaatgttgaattataataacttaacaaaattgtatttgataaaaatgaatttgctacaatagtttccgttaaggaatatgttaacatcgaagaatgtgtagtttttgttgaatatatttgcgaagatgtatttgctatcaaagtattcgaatttgtgaatgtatttgtatgaggaaatatatttttaggacagccatcatttacttcatatgttacattcaaaataccaaattttgtctcttgataaaaagattgtaccattactgtttgtgcttttacattagtaaatgcatcatatgcaatatctggttgatgtttcccataataataaatacattttagtgatttacaataagaaaacgcaccgtttttaattgttttaacattttccccaatgataaccaattctaaattaaaacatttcgaaaatgaacttcttttaatggaaacaattggatttggaatagtaatattttttaatgaagaacattcgtaaaatgcaaaacgttcaatagttttaacattatcaccaataataactgtttttaaattagaacaacataaaaaagaatattctcctattaaagccacgatatttttgataattattaaatctaatttagaacaatattgaaaagcatattgatttattttagttaccgaatatggaatattaattttttctcttgaaactgggcaacaaataagtacacttatattcttgttatatagaataccatcattttcataatttgaataatatttattttcattcattacattaataaaatctgtatatgaaaatgcactaattccaatgaaaattattgagtttggtattgtaatattttttaatgaggaacattcagtaaatgcaaattggccaattgttttaacatttttaccaaatattactgattctaatttagaacagctaaaaaatgcactatttccaattgtagaaacactatcaccaaaaacaactgattgtaaattggagcattttgaaaacgtaaattcatcaacaatcataactaagtttggtatagtaatattttttaatgaagaacactcaacaaatgcattacttccaattattgtaacattatttccaataattacattttctagtccagaacattgaaaaaatgcaaatattccaatattaattactgagtttggtatgttaatactttttaatgaaatgcaaacataaaaagcattatttcctatcttagtaatattttctccaatgtttactgattttagatttaaacatttagaaaacgcatattcaccaattgcaattacagaattactaatgtttacagtttctaaaaatggccattcactaaaacattcatttggaatatcaattattccagcactaatgataacattgatagtttcactcttgtatagggttgaaaaatcattgggacttaatataacaagtgttccatttgaaaatacttctaatgtatcgataataaaaaatgcaaaaataaagggaaatggtgtgaaattattgtgatcaaaaaagaaagagatcgaaataaatttccgtacaataatcaggaaaattaaaacaatagtaaaaaattttattattaaataaaaaaagaaaaagttttcaactatgttatcatgctgtaagaaatgagtaaatacataagaaatttttttcataaaactcattgggaatataatcttttgatgaaagctaattatgatcatgatttgttgtgattgctttaaaaaatctttattgatgttgaaaaaaaattcttgaaattgtatgtcatgctgattattaacatgtgttttttgtataaaattattatgaaaataactgacaaataaaaaatgaaacattaataaaaataaaattatttgattttaagaacggtttgtgaggataaaatgtaataacacttacaaaattcaaaatgcataagatcaaaatccaatgaaaacaccactagtgaccgctgagattgaaagtaaacaacgtatgaacaaatataaattcaattttgcatcactttcgccatttgacattgtcacttttagcaattgtgcaaaaatgaaaagtgcaacagaaaataaattcaatcagatttgatcgattttaatttccaaaaagttacagaaatattaaaaaaggaacctttactcatttggaattgagatttcgccagatgatatcttcttttggatagctttagcgttctgtccttcacattgagcacccatagcttggcaagtaccaagaacttccttaactgttcctgcaagtgtctttgacattgacttatgtctcatttgacgagcaatgtcgatgacgttatcaagagtaaggctacctgtgtgtttgacattctttgtcttcttacgatcacgatgtggttcttgaagggcatggataataagagttgatgttgaaggaacaactgagattgtagcttgacgatcaacaattgtgatttgaactgtgcaacgatatcccttatattcttcggtagccttagcaacttgttgaccaacttgaccagagttaacaccgagtggacctaggcgtggggcaagttttgcagtaacaccggattctcctccccaaacacgaacgcggataacaacttcttgtgacattcgaaaaggtcgaccataacggttattcacgtcgaacgtttaaattttcagtttgaaatttttgtgggaattatataattttaagttttaatatggagaaaatgacattatcagacttaaatagtaaaattttaaaagacccttcgaagcaacttattatcgatgacaacttatccttgtttcaagatttagtatcacaatatattaaatcacaaaaattaagttctccatatacagacgaaactgatttttttattaatacctttgttccaaatattgtttctcatattttggatcatggttttaataagttacatacaaataccattaacaaatatttaaattcaactattccacttattcccattttatttttcagtgatgcaaaaagttttattaagccagtccttcgaattatcattggtcaaaattgcaaattttactcatttatgaatccatatggattaacttctcattcatattctgaaaacttaagtacattttctaaaacaaattttttttcagatgttatttccaagttaaaatcatcctatgactttacatttcaacaagcatgttggattttacaaatcataaaaatatacaaaaatttaccaaaaattcaaacacaaatatcagatttattatttccaattttctccaagctaatagacaatttaaaagatgaagatattcatggtacagatgaacgacaaacagaagaatgttttaaaacattaaaacaatatatatcaaataaacaaaagaaaaatgttgatatgataaagtttaatttatcattaaaatatgcattatcacaatatattaataaacaatttcaaggtttagcagctattaaaaatgaacttatgactggtacattagataaagaatatttatatcaagttttagatgaatcaaatttcatccaaaagatgttagttgatcttcatattgaacttgtaccgaatttttgtaacatatttaagttaatggcaatacaaaagaaagtatctgaagaagaattagaattgttttggaatgtttcatctacaaaaagtaattctgcaacagcaaatatatattgtaatggattagaaattatatattccggtttatgtatatcattaaggaaatttttatggaatttaattggagaaagtaaacaattttctattgctacacttaaatttattaattatatatcagagtttggattaaatgaaaataaaatacaaatatttgaagcattaaagaaattttattataaaatcgataatgatattgaattaaaaacaaatttattcgaggcattaaataatattgttcctttagatcaaagtttctgtaaaaaaatacaaaagaattgtataaaaatgattaaaaaacatgaaaacgtcgaatttgctttaacattatttcaagcttcttgtaaagtaatggatgcaaatgattcgcaatcatttttaagttatatactttctgcaattattgaaattgatcattcaacgcaattacaatttttaagtacaataaaatatcttttaactcaaataaaagagttaaatatgaaacaattcaaagaattatttaaatttacattaaatttaattgatattgattcaaaatctatttatgaattctataaaacaattattaaagaaagtgacatattaacaaaagaatatttattatatatattaaagaaattaacaaatttaaaagatattaatgatgaaatatcaaatttaattatatttatatttaaacaaatcaataaattaaaatttattacgaaaaacacaccaaaaaacacagaaaaattagaaggaattgagttattatggaattctatacctaattcattaatgattatgggttatttatgtgaaatatattctaaaagtattaaaaaatttaatattaattcatttatttcacgttgtttaaattattcatctgaattaaatgcattaaaaggtattttacaaattattaaacttattcaagatccaattgataaaaaacaattcggattaactatgaatcttttcataccttcattcgatatgtgtgatgtatatttagaaggtgatcttaatatgagtttacaagtaccaactgatattacgttttctgaattttgtttaaaagtttcgaaaattgtaaaagtaccacgaaattatttatatttttatgttgatgataaattagttatcgagaaaacatttcaattatatgatgacattcattttaaagtcgtttcatggacaggaaaaatccaaactaaatcgaaaatcgaaaaagaaaatttaccatcgataatattaatgaaatcacctgaatttattaaaagtttatttaataatttattaaaagataattcagaattatcattagtttcttataatatcttaaatcaattaccaacaaatgaaacagaacggaaattattattaaagaaaacaaaaaataaagattggaataagttattatcattagaacatccttattatttcttatatcgtataaacattattcaacatttaatatttgaagaagagaattggttaaatcatttttatgtttctaatggagcgaagacattatttgaaataatattaaatgaatcatttgatccatttaaagataaatatttaacagaatcaatttgtaacacatataaatatatattagaattaatgaaaaataaaaaagttaaattaactttaatgaatgagaaaattatttatgaaattacaaaatattcattagaatcagatgatatagaaatgattgaaacatttttaacaatattatatcaatttgctattttggaatcaccaattttccaaaatgtttcaaatattccaactttatttgaaaggtttatcttttctgagaataaaacgattagagaatatacaacttgtattgtatcattttttaattatcaagcatttagtgataatttaattaatatgttaccgaattctgtaggacaacattgttctcgttatttttatttattaaaagttttatctaaaaaaacagatgatccaacaaaattattaaaaaatgttttaaatgttttctttgaggaatttaatatcgaatttaataatgaatttgagaaaattatgttttctttgccgaataaatcatttattgatggaataatttcaacaatttatatcttagcaaaaaaagttgaaaatattccaaaagaaaaacttttgtttactatattaattgatcaaattttacttaataattatcatatttatatccctaaaaaagatttatttttgcttttggaattaatgattaaaaggaatttgaaactttcgaatattttattctcgaaagttattaatattccaatgatatcatctaaaaaaacaatttatagaatgcaaaaaaatggaaatccgccaggcttgaagaacttaggtgcaacatgttatattaattcatcaattcaacaattatgtaacattcctgaatttaaaaacgctttattacaacaaacatttgaagaagataattggataacttcatttcaaaaacttatagcaaaaatgagttttttaccaattgtttctatagatccgaaatttttcattactaaatttaattggtatgatgagccaattagtttttataagcaacaagatgcagtagaatttattcaattattaattgatcgcttaaatgatttaataccttcaatcgaatctatatttaaaggtacaattgtacatgaaactgttggtaatgatgttgattatcgatgtgaaagtaatgaaaactttataacattttcactcgatgttaaaggatataaaaatattcaagaaagtttagaatcgtttttaatcccagatgatttatctggtaaagatcaatatttaacagaagaatatggaaaaatcgatgcaaaaagaagccataagatacttaaagcgccattaatcttaataatacatttaaaacgattttcttatgattttaatattggaaaatataataaaattaatagtaaatttgaattccctaatgaattaaatttaacatcgataatgaaagttacaactgatcaacaaatttatgacttaatcggtatacaaatgcatatgggttgtgctacttcaggacattattattcttatataaatacaagtaaaaatggttggctagaatttaatgatgatattgtaagtgatttcgatccaagaatgataccttattgtgcatttggtggtaaaaaaagttattctagcacaagtggtacaaatgcttatttattatattataggaaaagaattaataattcgaatgatgaaatgttaaatataaattcgataaatacaaaaattttcgataaaatttcaaatgaattaaaatcaatcgtattaaatgaaacaactaaaaatcctttttataaagatttgattgaaagtatatccgaaatttccgatgatatacaatttttgttatttaaacttgttaaaactgatgacattgaaacaatcgaaaatcttttgatgaaagttaatgaaaattgtaaaaataataaagataatgcaaatattattttaaattcgaaggaattaattgatcgatttttaaatgatttcgataatatttcaattcgtttattatattccgaaattttatgtaattctattttatgtattaaattttctaaatcatttttagaatatttcgaagatattcttaatttacaaaatgttaaacatgaagaagtttttattccattcatttgtattatcgataacttaaaaatagattatgaaaaatggataaaaatatttttgaatttattagaaaataataaaattccaaaatatggtaaattctttgattcattattaaaattaatgaattcaaatgaattaacagaagatcaaattatggaattgttttctaatgaattcattgcacgtttttgtaaatcgaaattaaatggaagtcaaattacttcttttttagcatcaattattttattaaatgttaatcggaaaaatgaatttataaattcagttaaagaaaatcttcaaaaatttgaaagttatgaagcttcaaattattttagtatattattatatatatcaaagaatgaagaaattgatataaaatatttttataattttttagaaacacaaaaatcattttataaaaactcatttatagaacaattaataaattcattaaattccgaattatcgaatatttttataaataattcttcattttggataaataattttttgttttccacgaatgctaatgttcgagaaaatactgtttcattatttaaaatagtttttaaggattcaaaagaattacaaataaaattaattgatattttattaaagaatttgaaaacattacagaaaattgtacaacaaaaagaattatattgtgcaaattcatcaatacataaaaagaaattaacgccaacagattcatattgttcattattagaatttttagtaaatgaatcatcgtcacaagaaatattaataaataattccatcattttaataaatacaatgataacagtatcaaaaggaaatattttcggtgctgaaaacttcgaatatttcattaaattgtttaataacacattaactaataaattttcaaatgaatttttcacaaaacaaaaacaaatcgaagatcttttgtcattattagataaatatattccaagtccattcgttcgaaatatgaatcttttacttagtttttatccaactaaattcgcaagcgcattctttaactcgaaaatattcgaacgcgcactttattattgtttaagtaatggctctgttattaaattcattttaagtcttgaaaatctatcgaaaaaagacataaatattatcatagcaaaagtttgggacaaaattaaaatgcataggaatagtacaaacacaaaattatttaatgaaattttagagggtttatttaaacgatatttcgaagcgactgaagaattttataataaagaaatttatttgaaaattattaatttaattgataagtctccaaattcaaaagatttgtcttatctaatatcattattatcatgttttattagttactttattaaagaaaaagaaaaccaaaaatatcatcaaaaatttgtcgaaattttacatcaacaaaaattacaatttaacagaattatcaaaaagttatttgaccaaaatacaacacaaattttgtttgaggccgtttgtaatttcataactgtactttttacaatcgattcagtttttcagaagcaggtcattgaaatttcaaaggacaaattcattgaaaaaattaatgttaataatcaattatcaggtgttgcttttattaatgatatttctttcttattacatcaaaagaataaaaccgaagatgcatttagtatattattagaatcgatttcatcattaaagaaaccaattttcgaagcactcgattatttaagtgtacaacttggaatgattataacaaatgataattgtgatgaagttgatgaagtatttcgaaatgtttatgagaataatacttcgattcttttctttacttttggtgttcaacgattaattttaatgttttcggatgattcgattaaattttgggcgaaaaaatgtgaaaaagaaataaaaaataatattaaaaagccttataaacaaagaaatattaatccaattaagaactcattggaattcttgttaaaggttaaaaaaacaaagaatttaaatgttaacgttaaaaagaatgaattcgacgatttcgtaaaatattgcgataaaagtggagaaatatcagcaaaggatttggtgaaccttgtaaatatattgtgtgatgaggaaaatgagaaataatttatttcgattagtaaaaattgttataaaaatattttaaattattcattcggtttcaacaaaattttagataaatcataaatttttatatagtttgttagtaaatagaaattttaacatatattcagtcccaaaaatatgaattaattaaaatatgtaaagaaaatagagaaaaaagatttttttcatgacaacgttctccttagtgaagtgagtgaaaataggaatattgcgaaaattacaaaattaaatcgaaaaaatttttattaaatatttaaccaaatatgttctttatttataatgctacagtgtggatgtaggtttatattaaggtgttggtctacaggtttttcattgcgtctatgttttaaattttatgtttattgagataattctacaaattataaaaaagattattagcgtaaattatgtgaaaatgaaaactatatatttattattttacaagaaaaaatataaatactcgcaaataaggatatgttaattaatatttaaaaaaacatttattttatcatgctccccaaccttcagtatcatcatcttccaggtcatcgggaaattcaatttcgaaagactcattctctaaatcattttcgttttgtttcaatgttgatgattctgtttttgttttatctaatgtattagaaggaaagccatcagattggaattctaaagaaagttcttcatcattatctttataatcttgcattccagcaaataatgttgtattaatttcggatggtgcattactttgatcattgatttcttcttgttcttgcattgactcttcttcaagttgtggtttgaagtgagcaattgtttcactagcttcttcttcagaagatgaatcttcatacacaaaatgtcgaacattcatttggtcaatgtattcgttctttctttgaataggttgattgtgaatttcttgcttcaaattgcttttaatatcgatgtttgcgtttgaattaaattgtcttgtgtctacaatatgattttgtggatctataatttcattacttttttgttgatctattacaatttcttgtttttgtgtattttcactttcttgtttgtttattttacttaaaagattttcatccacgcttttgtctgtttgattttgtatgttttctatttttgtttgattttgtatattttcttgttttgtattgcttgattggaatttggtttcatttgtttgtttatttagtttatattctatgttttcttttaattgtttatttgttatgctttgtatgctttcttgttcttggatattcgatttcaattgtacttcatttgtctgtttatttaatagatattctatattttcttttgattgtctgtttgtttgataattcatattttctttttgataacttgatgaacttttactagaaatcaaatcagaaaattttgtaactgacgttttatcagtatccgaatctattgtttcatatgattgaaaatgctttggaacagagatttccaaagtagccgaaattcgttttgaatcatttttgtttgtttgttgatatttttcttcatttaaagaagaaaaacttaaacgcctctttaaaggttgatcatttacaggttctggaagttgtattttaataggcttaaatggaagtggagttgacgcgttgttaaaagacaatttattattaaattcatggaaataacaattttttaaaactctatctgttttccccagcaattgatctccttcttgttctagttcatgaagtctctttttggtattatttttttgcattggaaatgctggaatttgaaaactgtactttttgttctggttggatctttgaattcttgcttcaagttcagaaatttgattggaaagtttcgcaaaaatttcaacatatttatttttttccatttcaattgatttatgaagatcttgattttgctttttaatcatttctaaattatatgaatattttctgtgttgattaataatctttgtttttaaatttctatttttatgcctcaattttttgatttcattttcttccatttgttcttaacgtacaaaatattttgctcaaaacgatttctttacctttccgcatttctcatatattccaatacaaagtcaaatgcttcaaaaatgtttaaccacactcacatagatgtccatatttcaaattagaaattgtgaaatatgattttgttcaatatactttgaaactagcttcacaagaagcacgacgtttattcactaaatgatttacgactagaatatttttttatgtcctacaaagaagaataatttacgatcataaaaggttgctatcattcctctattcattttgaattgaaagtggtcgattgccattgaaaattgtaaatggccatttacaactgttcacattttatgttcaaggccaaaaaacctcaaaagcaacaaaaaacaaatgataatcagcagttaaagagctatgccgctagcttttgcaccgctgttgtttcaggggtagcaggtgaaacatacatgttgattcaaagtaggaagctcaatactcaaaatttacttgcaccagcttatcgcgatgcttgtgttatatctggtgtacaacaagttgcgaaagactttagcaaaaatacacttaaaaaatcaccttacttatacaatttatctgtcaaaaacccatttatttttggcgcaatgacaggtctcccaatgtgggctttaacacgtttggttgcaaccccactccaaaactcaaggaaaactgatgttaagcaaccatttgatggcctctttaaatcaatcataaacgatgttggatatcacacagttaagaatggaattgatgaatactttgcagccaaagtctttccaaaggtacttccacagcttcctaactttgcaacccaaaaacttgtcgaagcatctcttgctggacttgttggaggcgcatcatatgtcatttcctggccatacaaaggcgttttaacaggtcaaaacatctctgaagccgccaaattaatgttaaagaatactccaaaggttgcagtcaagaaacttacatatacacttgtgagaccacaatttgcaaatctcattaaataaataacttcaataatttaaatttgttataaagatgaaatcttatgaatattaatattgaacgaatttattgaaaaattctctcaatcgaatattgtatgaaaatgtttttaattaatttttaagcataaatttttttatttatgttttttgatatcacacaacaaccccaaaatcgattcaataattgagaatagaagattcataattcaatactttcagatgggacacatcacctcacattcctacctcctttgtgctgaaaatattttcatctcatttttttgaagaatgatgattcttttacttggcttgataagctgtaatgatttcgtatatcgaatcattgataaagataaaaaaactgcaacaatattaaaagcgccagataaaattttaaacttatcacctgataaattttgtaaaattaatggaattaattatactattattggtattgaagatgaagcttttaaaaattgcaaagatcttagaacagtcagaatttcagataccattaaaacaatagggaaaaaagctttttataattgtacttctttaatagatgttgatttaggtgatgttaaatttattgatgaaaatgcttttcaaggttgtacttcaatttataatgtattatttggaggtttatatgatattcaaggatgtcataatttattcgataaaaacatcacaatatttgttgataggaattatcaagacaaaacattctgtggttataatgttgataaatctttagaattattcatttatgcaggtcccgctgtaatatataaatggtttaatgaaaataagaaagaaatttcattatatagatcacttgaaaaaaaggtgtttatacaattccaacagaattagttacaaaagaaacttataaaatagtcggaatttatgatggtgcatttcgtaatagcaatgatttaactgaagttatcattcctgatggtattaaatatattggtgaagaagctttcattaattgtgcttctttacaaaaagtaacaatttcatgtgatgttaaatatatcggtgaaaatgctttcaaaggttgttcttctcttaatgaaataatatttgaaggtttatatgatattcaatcattgaatgtattcgatcattcattaacaatatttgttgataggaattatcaagataaaaacattctgtggttataatgttgataaatctttagaattattcatttatgcaggtccaactgaaatatataaatggtataacaaagataagaaatatgtttctttctatagaatactctctaaaggaatttatactgtttctactactgtttcaacacatcctgattattctgtcatcaaaatttatgataatgcattcgaagatcgtaaagatttaactgaagttatcattcctgatggtattaaatatattggtgaagaagctttcattaattgtgcttctttacaaaaagtaacaatttcttcttctgtcgaatttattgatattaatgcttttaaggattgttcttctttaagttatgtatatttcaatgggaataatgaaattaattataatgatcctgttttcccttcatttacaaaaatttatgtttctgaaaattataaagatgatacattttgtggaatgaatgtaattaaaatacaatcaacttcaatatcaacatcaacatcaaatgataataataactttaacaataataataataataataataatttagaaattcaaataggtaataatattaaagatgaaacatcgaatgttcaaaaagaaggaaagaaattaaatatgatattaattggatgtgttgtcggaattgctataattgcaattattgttggtattacaatatttattaaaacaaaattacataaagaagaagaaattgatgaagaaccaatgcttggtaaagattgtaaatatactgaaatattggatactgatccttaaataataataataaacattttaattcaataatttttattttgtttttgttagaattatataacacaatctactaaaacacgccaatgaataaactcagatcatgaatgataaaagtaattctccaataaaatttcagaattattaataatctaccaatcattgatttatcatcataatcaagtagaagcaaataatcaaacctttaaaacatatttttcgttgggttttaaaagagtctaaaaatgttactcatgattatataaactttatatagataacatatataaataaaaaattcttaaaatcgtcaacaaagagggaaatgttcaaacacccaatgtttatcactttttatagttttgctgaagcacaacacaattttgaaagcgagataccacatttctgattaaaaaatgttatatattaggcacctgtccaaaaggtcttttagcggtgataacattagtatgattgtgggcataaaaattagaggtaataatgtcagtagctacttgaataattatttaggctccagatcaaagttacaaataaaaactttgcaaatataaaaaaattctttacaattaatatatatatataaatacgaattagtataaatatataatgtatattcgagagatttaaagaaattaaaggtaacctgaatttagatttttgcccaaattttaactttttattaaagtgcattctttcattaattttttgattttttaattcatttctcacttgttgtcaagaataaatacgtgcttgttcacttagagcaaaaaaccatctattttatttggtccttaagtcgatgttacaaaaatttcaaaatagatttgaagtagaaaattgtaagttaccatgttacaatagaattgaacacttttatgtatcatatgtaatataaaagaatcgataccaagcaaatctgaaatagtaatgtttcatcaagaaatgtgaataaataattttttgcgaaccaagaggaaatgttcatattgatagctgcatgtgcaagaaattaaataaatcgatatgataatttactcaaaatcccaaaagtcacagaagttgaagttaaatgtttgctcatcgcttgagccaaaaaggaaagggttgatgttaaattcgtcaaaattacttaaacaaatttcgttcgagttcgaaatagcctctgaattatcaagaggttgttcaacatttcctctaattattttggagatttgatctagttcattcaaagtgccttcttgaaagaggaatggaagttaccatgccattaggtacactaatgattataacttttattctttttgagtttggacttcttcttcccattatatgataatgaattcatctacacgcttatgtcacaacaaattctaatgtcacttttatctcaaaaatggcgtaaacctttaaaataaccgataagcgtgtagcagccttaaaaaggtgcatatataaaaagttaatgtagattaaagcttagcatcttatttgctagatttaataacctatgtgcaagactctaaaaatatattgaattacatgatgtattttaaaattatattgatttaaatgtatcttaatttttcatttttttatccatagtattacctaaatgtattggtaacttttattgttatatcttaccttccgaaattaaatcctgtttactttttatcaaaaacaaatgacaaaatcactaaatcacttaataaaatatatttataaatatattttcttataagtatcattcaaataatcaatttaaaaaatgttcacccaagtaaaggcacattatttgtttaatttttattttaattgaatcatttttcacgtttaaaatttttgatgaaaaatagcaaaataaaaattattgaattaaaatgtttattattattatttaaggatcagtatccaatatttcagtatatttacaatctttaccaagcattggttcttcatcaatttcttcttctttatgtaattttgttttaataaatattgtaataccaacaataattgcaattatagcaattccgacaacacatccaattaatatcatatttaatttctttccttctttttttgaacattcgatgtttcatctttaatattattacctatttgaatttctaaattattattattattattattattgttaaagttattattatcatttgatgttgatgttgatattgaagttgattgtattttaattacattcattccacaaaatgtatcatctttataattttcagaaacataaatttttgtaaatgaagggaaaacaggatcattataattaatttcattattcccattgaaatatacataacttaaagaagaacaatccttaaaagcattaatatcaataaattcgacagaagaagaaattgttactttttttttttaatcacaattaatgaaagcttcttcaccaatatatttaataccatcaggaatgataacttcagttaaatctttacgatcttcgaatgcattatcataaattttgatgacagaataatcaggatgtgttgaaacagtagtagaaacagtataaattcctttagcgagtgttctatataaagaaacatatttcttatctttgttataccatttataaatttcagttggacctgcataaatgaataattctaaagatttatcaacattataaccacagaatgttttatcttgataattcctatcaacaaatattgttaatgaatgatcgaatacattcaatgattgaatatcatataaaccttcaaatattatttcattaagagaagaacaacctttgaaagcattttcaccgatatatttaacatcacatgaaattgttactttttgtaaagaagcacaattaatgaaagcttcttcaccaatatatttaataccatcaggaatgataacttcagttaaatcattgctattacgaaatgcaccatcataaattccgactatttttataagtttcttttgtaactaattctgttggaattgtataaacaccctttttcaagtgttctatataatgaaatatatttcttatttttcattaaaccatttatatattacagcgggacctgcataaatgaataattctaaagatttatcaacattataaccacagaatgttttgtcttgataattcctatcaacaaatattgtgatgtttttatcgaataaattatgacatccttgaatatcatataaacctccaaataatacattataaattgaagtacaaccttgaaaagcattttcatcaataaatttaacatcacctaaatcaacatctattaaagaagtacaattataaaaagcttttttccctattgttttaatggtatctgaaattctgactgttctaagatctttgcaatttttaaaagcttcatcttcaataccaataatagtataattaattccattaattttacaaaatttatcaggtgataagtttaaaattttatctggcgcttttaatattgttgcagtttttttatctttatcaatgattcgatatacgaaatcattacagcttatcaagccaagtaaaagaatcatcattcttcaaaaatgagatgaaaatattttcagcacaaaggaggtaggaatgtgaggtgatgtgtcccatctgaaagtattgaattatgaatcttctattctcaattattgaatcgattttggggttgttgtgtgatatcaaaaaacataaataaaaaaatttatgcttaaaaattaattaaaaacattttcatacaatattcgattgagagaatttttcaataaattcgttcaatattaatattcataagatttcatctttataacaaatttaaattattgaagttatttatttaatgagatttgcaaattgtggtctcacaagtgtatatgtaagtttcttgactgcaacctttggagtattctttaacattaatttggcggcttcagagatgttttgacctgttaaaaattaatcataatcatcatccagaaaaatacgtaataatccaaaaatttatatttatttcattaaagaattaaacaatgcatctgcataagatggaattggttgtatgacacttgtcataaagttttgtaactcgggaattatatcataatggatttgccgacttcttaacaactgcttctttggctttgttgcaacaactttagtttccttcttttgaattccaacaacatcagaaagaagccgtttataccaattcgaatcgttataaacatcattcacaacttcaggctgcgtctcaaagccaaagatcttgtcgccccgctctctatgtcttgttggctgtataagaatctccttatcactaagggcagctgaaatctgttgatcaattggtcgattgataacaactcctttcttcattccagatgaaagtcttatacgctgagaccagtgggatatgttttcaatcatccgtttcgcagcttcggactcttcccattcatatgtattttcaatttccaatttaagatgatgaagtttctcttgaagagcaatggcagactgactgatttcagcaagcatggaagcaacttcttgatcttctgtagcagcttgaaaaggagtaatatctgattcttcggtatgtacgttcgatggcaataaattaacagctgaaagtgcaccttgcatttttagccttagtaagagtaaagcagaatattgattttgaagagcagaagtacctcgagcaactttgagatctgcttcttgttgtttttttaaggaatcaagaaggccagctccttcatctttttcaagaagttcaagttcggcttcaaggtttctagaaccatctggttcagggatgtacatatcactttcagaataagtatcatcaatatcttcattagattcatcactctctggctctgatgcttctatttcttttcttgatactttttgtccttcataaattccttctgttggaattgcatctgttcttaatcttgatggattaaattcaatttcttgatcaatgtactcttcactttcagacgttgattcttcttcgtcattttcatttaatatctgtttgtttatttcatctgccctaaattttcttctcattaagtttaaacgaccaaatcaaatcgaccccagataaacgttctcctgaattgaatgctttctgacggttatggtcggccttttgagatgggaaaagctcagcaaaaaggaaaggcttccaagaaaatcaagcaagataccttcttaaagaaggagtggcgtcatgttttcgtcccaggattcttttcaaaacgtgatattggattcactgtttcacataaatgcgctcgtggaaagacaccagctgattaccttaacaaccgtgttttcgaactctcccatggtgaccttgttgacgaacaatctcatgcataccgtttgttcagctggaaatcagttgatgttcaaaataatgacgtattaactgttttcgctggaatgagactcacaaacgataagctctcttcactccttcgtaagtatcgcacactcatcaatgctcaagttgatgttcgtacagcagatggatacattcttcgtgcttttagcattggtttcaccaagaagttgaatccaaacaagaaggcttgctatgctcaacaatccaagaagcgtgaaattagagatgcttgtattgctatcatgaaggagacaattgaaaagtctacaatcccagaattgtgccaaacaattgtcaacgaaacaatcgaaaaggctattgttgaaaagtgcaagactatcatgcaagttgataatgtctatgttactaagattaaggtcattaaggcaccaaccttcagcggtgacgaactcaagaagcttcaccaaggtcgtgctgttacaaaggctgccgaagttccacgtcctgttgaagaagaagccaaagcagaacaacaataaaatttgaattgaatggaatttgatatttaatttttattaaaatattaaccaatttttttttatagaacttactgtgattcaaaatctaaacaaatttttatgtgagagtactctcactagaatcgataagtatacatttcatgaaatgattgaaataccaaccccatatgaataggtgtgaaatattagtgttgatctgatccaatggttaacacttaaatttacaatcatttattttagatatgtattcggaactttctaaagattgtgaattgattttgtatcttttacaaaaagtacagataaacgtcttccagcacagggatgataggagaactttatcttttaaaaaatccaaagaagcaaataccaattcaggctatcctaccacctggacgcaaatttcaaagaaaaacaaaaaaacataaagaacagcattttccaaaagttgattttgaatcttatgtaaatcgtatttccgaaatacgcattgaaaaagaaaatgaagaaaagcaaattcgtgaagaatacgaagaacaacaagcgaaaaaagaactcaaaaaaatagaagaattaaaagaagaaccatcattaattaccgaaaaagatcaattcacaaaggaagaagaattaccaaagaaagccatagaacccaatgaagaagaggatgaatcatttgaagaagaagaagacattacagaattacttaatcaaccactccccaaagattttgatccttgtcgctgccttaaccaacttactgaaagcattagtgacacgcgtgttcgaagtcattttttgcaactttattcacaagaaatccttattcaaatcgaagataaaagaaatgaattccgacgtttccttaaagttatgagcgagaaatgttccaacgagaaagagaaatccatttgtttttatgcgtatgcattttctcatcttcttgaacctctttctttagatgatatccggaaccaaatgttaccaatattttttttgttacttccaaaacttgctaagaatgatattaatatgaatgattgttcacattttttgtattttatgcttgagtcattagtttttaaacctgagcatattaaagtacttgtgcctttgattgttgataatatgattgaattgttaaataattcgctgttcgatttggcagaatgtgtcgaatatacattgaagtcactttcatttagaaagttaaatgatagaagtaaaatagatagaataataccagaaatagaaaaaagatgtgaagaaactggtgcttcgtataaaggaatgttttatagaattaagcaccctgtaaaacaaacacaaatggaaaatttccttaatacattaaaaattaatttaaatgaataaaattgttatttaaatcatttttttaaatacttcataaaacttcttgtaaaaccattcttactgttaattttcctcttgttaattttttcataattaatcaaactttgttatatttcttgcacctcattatgactcagttttttgactttacgtctcaactttttctattctattcaaatttttctaaaagtttatcaaacttcaattatttgatgtttaggggagttttgaatattcgaattgtgaaaatgatgacgtttagaaacaatttttattggtgaaaatgtacattatataaattcatgtgcatttactaattgtacatcacttcaatgtattcattttaataaaggaacttcactagaaatacaaaatgatgcatttgttaatataaatgcgacaacagttatgacaatagaaacatatcaaaatggaacatttggaaatatgaatgctactaagggaacaacacttgacgaatgtctcccaccaacactcacattcacattcacacaaagtgatacattcaccaatttaaatacatttacaattagtaatacatttatcaaatcgaatacatttacgaaatcaaaaaataattttgattcaaatacttacgttaatacattttcaatgaattttactttcgttaatccttatactttaacttattctttatcgtttataaaaactttatcaatttattattatacgttcttaaaatcttattcaattactttcatcgaatctgaaactaaatatatttatgtcgattttatatattatttataatattttacttattattcgaatttcttttatatttcttatatcgaagatgtaataataaacactaatgataataaacactaatgataataatacattaattatcattataattgttattataattgtaataattattgtgtttgtaatgataataataaattttatgattaaatatcaaaatgagaagcgaaaactaaatgaagaagaaatgaacatttcagaagaaaataataataaaattaatgaaatcgataatacattttcagttggtattaataattcaaatattgaagaagatccatttgcaaacgatttcaaagaagaaaaatttatatgtcagatctaaataaacatattttaagaacaaaataattttttgtttatttattaatttattaaatacaaacatttttgttatttggcaaattttatgtttccttccattaaatttttatatgtttattatagatatgcaatagaaacattaaattttcatacaagatcgttttcttcaaaatctttagcaaatggatacttttcaaaatgagataaattaataacattttccgtattaatattgttatttattgcatttgcattttcattttattgataacttaaaacactatttcgtttagtttgatgatcataaattaaaaagataataagaagtgaaatcataaaaataattacaatacaaacaattacaattagaagaatttcttctgtttctttatttttatttttattcgtttttcttcattataaagaataatataaaaagcagaataatatgtattatataatgaataatcaagaatgatctaataataaacaaatttcgcttcaatttaaaaataaaatgagttaaacattgtaagttgataatagttttggaaatgtttgtgtaactgtttgttaaaattaatgcttgaacgcattttacaccaaattgtaatacaagtgttgaccagacaacgatatcgttaccaatgcattggtagacttcttaatgatctgaatgaacccattattatgcttccgacatgtgcacagttgtcaccgaatgacgttgaatgatgtcttcttaaagagccgactgaaccttattattaggcctaattgttgagctggtggattggttggtttcgaaacaatgaagttcgaaatgccgaatttgttctgcgtattttgttataatatctatctgaactaaatcttccgctaatatgtattcaattagctgtggattcaatgcaaattgtcatccatttctttgtattcgtatcaaaacacagtaactgaaacaaataatttcaatgtattaacattacataaatggtatcacagtaattgttcaaaaacacatgtttaaaaaaaataaatgattttacaattataatctcatgagattatttttggtttagataataaagtaattaaaagtcgtatatttctagatatgactaatggcctaactttttttttgtgttcggagaaatgctgaaagaacatatttgcggtgatattttcaaaactttgtgtaaaagtgacgcagcatatttggccaatccaatgttggttttactttccttcattgcattagcaaaggctgatttcaactacacatcattttttgaaggcaattggaacataacagcagttccagttggtactgatggcgaagaaaaagaagaagaaattaaagtttattctttagaattatcatcaggcagtgaaattggatcacttattggagatctaattggcgaagatgaagatggtgttgctactccattaaataaaattctcatttcacccacagatgataatacaactttcacgttctcaatttctgaaagtgaagccgaaaacttcgaagaagtttctacatttaccttcaaatcaggtgttgatggaatgaagtcatcccatggcaaaaccacagaaaatcttcgttactcaattaacattctcgatcagtatacagcacaacttattgtctatcaaaacgaaggattcacaatctatcgccttatcaaggaaatcccacagaagaagccaagtcttttacaatctttccttccaatgctcccaatgcttatcatgatgttcttcagacaaggcggaatgggagccccacaggcacagcaaggtcaacaaggtcaaccagcaccacaaggagaaaaagctaagacagactaaataaaaaagtcacattttcagacatctttcaataaattccatattttgatttgctaaaacagtaaaaaatataaaaaattcagaaatgtgaaaaattattatttatcaaaattcaaaaataagaacaaagattatgataagtgtaatgtcgtaccggataacatagttgtgagtaacaaaaatttatgagaaataaagataaaaattgttacgaaattaatttattaaaaaaaaactggagtaaacataaattatataaagtagaattacatgatgctttcaagctaatttttgtgtgattaaatagattcattcttctaatttttgatgtcaagtaattgcgattgagaaagaatttctttaaaacgcttttggaaatcatctattatatctgtcatttcagagagtaatttatcacttttttcttctgatgattcaattgtttgaattgaattatcataaatatcagcgatttgatacaaagaaattactgcccttggcaaaggttcataaatttctttcacaccagtaattatattggaaactgcagactttgagcacttagaaaagttttttttgtcactcatcaaaaacttaaagacatgtgatatgaaattattttatgaaatttgatgtgaaataacgcccgaccacgaccaaaatttcctacatttctccaaaatgggaagagcagctggcggacatagaatgagtgcaagacgtaagaagaggtatgaaagaataaatccaatatacgaacacagagatcaacttcttgcggcaagaacagaatatgacgttctggtccaaagcggaatccaaccagattttgaacagccacccgttgaccagtggaagagggacatcgctcaagctccaccaggaaataaagttcatgatcgcgatgaaattgatgctgatgttgaaaacttcaaacgtgcaaataattttccatactaaaattctataccaaaaatttattagagtagatttagaaatatggaaaataaaatcttattttttacataaaagtttaactttactatttacaattacttgatgaatgggatccacgttcttgtattctttttatattcaacataatcattaccaaaaaattgaactaatgctttttcttcatcatgaatgcgaatcttaaagaaaaaccaaagaacaacaaagaataaaactgcggatcctggatttatgagtataaattgtgttgcaggagcaaatataataaatccaagatatccaggatgtcgaatatatttatataaccctgttgtaattaaaacatgttcatctactttttcataagcaacgtcatgagtaaatgacattcctgctgtatacattgctttaaatctaatgattaatccaattattacaagaaccacaccaatccaaatgactggtgattttaaatttgatttatattcccaaaaatatctttcaacgccatattcagcaaaacttatcaagtatgcaataattgaatatggtgtaaccaaacaatttgcaagagttgtatgatttggatgaaatttttttgatatgatatattccattgtgtgataaaaaattagaattacaaataatattgcaaattggataatgattggaatataccattccatgtttctttaacgttcgttttggaatgctatcataaacggcctttgtggaagcatgaagaagcttcttaaccaaaaagaaatatgtgttgaaatcttaaaatttattcaaacagtcggaaaaatatcagttcctgatgtgttggtaaatcaaaaaatttttgcatcaatcaaatttccattgtataataaaaaagagttacaatctatttcatcagatttagaaaaaggcttagatatcaaaacaacacttcttaatcattcatttgcttttccattttttccaaattttcttgatgatttaattagaaaaatgaataaaaacacttacatatatgcttcatcatttacatttcttacatatttagcatggaatattgcatatggagattcaatttcagttgataccacaatcatagatttattatctgcgttagttaccatttggaattatgggaattcggaacaaataaaattaatttctgtttcagcatatacacaaatatattcaacattttttagcaatgaaaattttaaagcatttgatggatttctatcagcaatctacttatttttcgaacgaggccgtgttattccagaacagtgttatgagatcttaccaaatgcagcaaaatgggtatataacaattatttatcaaatccaaagatcactgataatttttttcgatatttatcgcaacttgatctccctgaaactgttgcacaaaaacttgtaacaattacttttcaatctttattacaatcgaattatactatttttccatatattccagattttttaaaacttgtatcaattaattttacgtctgcttttttatcgcgtgttccaattgaacttcttgattgtattagtttacagcctgttattaatgatataccttttgattcaacagatccaaatttcattgaacttcctaaagagaaaaacaatgaatttaactttaaaatccaaaaaaacacatttccaaatgggttagaaatatcacaaaacattgaaatacctaaaactaatacatttaatgaattaatgcatgattcaattatctcaaagtttacaattattgctcaatgttcaaagaacaaagaacatatgaaaatgattatcgcaaattttattgaattgcttaaaatcaaaactagtgaacgaccaatacatatttttgatttctatgcatcttttttttatttatgtaaattatttccgcctgattcaattggagaagttaattttgatttattaatgaatccaattttatttaatccagaaatcacagtattttatccatgtaaaaactttgatcatctaaattcaattcgatattattcacttgaattaatattaaatatatcacagaattatatcgaagagatcttacataggttaatgccatatccattattatttactgaaacattacataggatcatagcaaatcatcaaatacttcccgatttaaatgatgcacgaatatctttagcacatggattagtttcgagtgcattatattatcaatcatttagtaacgaaactaataataaaagtattgaaatagcacgaacaggaattttaaattttatctcacatatattcctagaaaagtcaatgttaatatgtttttttaatgattatttttttagttgttcatttctttctttagttttcgaggtaccacttcgatcatttgttttagatcaaacattaacatatttaacaaattcagagcaagttgaatttgatcataatttacttaaaatcattattcgtttggttgaaaatgcttgtaattatttccctgatattgattatattgatttagtctcagacgttttaaataaaattaatgaatctattacacatcgacgtaatttagcactacaatatgaatcattaactccgatcatattcaaagcgtttttaacattagacacaacgaaaaactcaaaaacatttttatataattcattatcatttttagttttaatatcaaatattcatttattaaatgatgaagaacaattatgtatcgaaaatgcaataaaaaatgtatatgaaaattcaccatctgataatatatttgaaacaattgttcaattattagcagcgaatggtttaatctataaaaatccttgtttttatatcaggcaaccaaagatattaactacttttttaaccatatttgaaaatacgccaaagttaattgatgtattacaattcattaatgatttatgttctttctcaccacataattgtatttcatgtcatttagatcatattgatttatggcttttaaacttcatatataaaaacattaataatgataaagttaatgaatatattattatatgtttaaaaattattgtaaaaatctcatcattaatatcatcaattgaagtcattaaaaaatttaatacattattaaagcctataaataatagtaatgaactttcatattattacatcgatatatttaactcattaaactcaattgttaataattccaaaattcaaccatcagtaactataccattatcacctgaatatataatttctatttcaggtttaaactcaacacatttagaatcttttcattcagtattttgggtacatcatgatacaactattccactttataagccgaaaatattacatttaatagaatcaacaaaatcaattgaagttagtttattttctaatcaagttaatatatatcaaaataatggtgaatatgaaacttatgggaatttaaaagtagaaatacctaataaagaatggatattaatacatttttcatatgagccgagtaataaaataggtgaatcactttttaaagtatcaattaatttaagtcatttcgaagaaataattataccaacaatgaaatggaaacaaaaaactttaattaattgtttcataggtggtattactaatgatagtattacacctgaattcccatcattaattacatgtttcggaatgttttcttcattagatgatgtaacattacaaagtttattcgataatggcccatgttttaacaaattaatatcattaaattcatgtttattcttttatcagccgaaagttaatgataataattattattttaaaccttttacgaatggcgattttaagttaactaattattgttcacatgaaacatttcataattcatttgtagatgtattaattcattcatttaaattaaagaatttaattcctttgtttgatttaatacctttaaaaacaacaaaaaatgaattagttccacatttcgcagaaacaattttaagtttattttcaactttatttaatgaaagtgatgaagcacaaatatttttcattgagtataaagggtttgatttaatattaaatagtttattaaaacttccatcgaattatcggaattataatttatatttaaacttatttaatttattagaatcattaaattatatcgaattacaaaacaaattaattaatgatatattaatcaattataacttatggattgatattgaagcagaaaatcatttacgtatattaagacattggtcacgttatttatttcctacatatttaccgaaaattaccacgaatataatcgaattaattatagcgttacgaatattttatttttatgataacaaatttaatgttaaaaatgtaaaacggaattcgaaattaaatatatctgaatgtagatcaataatattatcgatatgtcgtacgatgcctttttataatgattcatttaaatatttaattggtgaattattaaatttatccgaaattcatcaaattaaagatttattaagttttttattagtacaaatttctacagatctaacatttataaatgatttaaaagattttatcgaatcaattaatttacttgtttctttattaaacttattagatgatgaaattaattgtttaatatttaaaatatttcatcaattaaatcaaagcaatttaattgataataataaaatgtatgaacatatttatttaatattttatatattacaaaaggattttatccaagaaaaattctttaaatcattaactcagttaatgttaaatgaaaaattttatgaattacttccaatttgtttttggattgcttcatatataacaaatgatgacttaataaatgattttattgatcgattagagccaaatataaaatattcaacaaacccaatatggagtatatgggtaataatattaatatcgaagattaaaaacgaaagaattaaagaaaaattaattttgtttttaatcttatccgaaaatgaatattataaggtcacgtttactatgtttgatattattcttgataattatttaaacattaacccaaccgaaattaaagaaagttatttacatttgttttattgttcattgtttagtggttcgattgaaagtaatgaaaagaatttggatcttttcttttcattatcgaaagaatttattttctttcaaaagaataataaacaaaacaaagcatttcatgaacaatttaaaacaaaaactaataaaattaataatacgaaaaatataaaatttattacattaccaatgattattaattatttattcgatgaaatatcaaaacctaaaaaaagatatttcggattacgaattatatcatataataattggatcgatttcccaaacgctatcgaatgcatgaatgcatttctacaatataatgtttctatcgaaaaatatttaatattcgatttaataatttgttacttcgcgaataaaatcgataaaaaagaagtcgaaaatcatttaaaacaattaaaagaaaaaaattgcgaattgatcgaatatcaatcattcataaaatgcatgaaaaatgaagtcggagcttcaattgacctattaaataacttcgcagaacaaaaaatagatgatcaagtactgccgcaacaagtaaataaatacattgtgtcacttatggagaagaaagacgactttctgataagtgaaaaaaatgatatattgagatcatacgtcatcaaaacagtggatgaattcatagacatttattgctaaaattttatttagatttgtgttaaataaatttatttcattttgtttttgttttttaaaatatgtgtaaatgttctctaaaaagatcaaaattcattataaagatgccgtgaaaaacttgtcttccttgataagaatgtcattcatagaagctttttgtcaacctaaaaggtatataccaattttaatgattaaatgctaaataatatcatcatacaattgtgtttcacttaatatgcttttttgatgaagttatcgtttaaggcttttcatttttaacatcttccaattggatgaatttgtaaaagtcaaaatcatctgcatttttgataataaatatcttcccgtacatatattttttatcatgcaattgcaacttcgtagttgtatgaaagtagacagtttttcacggagttttttctaaatttagtattataatatatcacaaattttaatgttattttttgtagaacatttttatatgcaattcatatattataaatttgaaaaattgtttaattaaataagttatatatatatatatatatatatatatatttatttatcatttatttcagtttaactaaatatggttatactgtgtaaacattataattatatgaattcagaaatttggaaatagttataagtattgactccctgtttatcgagacctaacaaaaagcattgcatttttagccatttttttaaaattatcccgcccataacctaatgaaatcatattatgaaacacttctctgtttatgataacattattttttcttgagcagttcatagcatattgtaatatagtatcaatacaagttgagattaattcatctttaatgttttcactttgaagtctcaaaatgttttcaaccaattgccacaattgaagtatttgttttcgttctttttgaaaatcttctggagaatttccaaatgacatcgcatagaaaatttttgcataaactttataacattttaacaaagatatataaaattgatttgcataatcaatattttcttcaaggtttttctgcttttgatatatatccaaaagaatttccaatctactgcgaaagctatgcaatatttcttctgataccgaattataagaaaaaatttcgaacaaatgtgcaaccaacattagcattgatggataagcttcactcaaatttggttcacaattaattatatcgaaaaacaagcataaaaaatcttgtaagaaaaagattacgtcattttttaaattgaaaaacatgaagaatattgctctcatacataatgatttttcatattcatcggatgatttaattagtggtaaaaggattcgcaaaactaccccaaccttttgttcgacattagttgaaaaaagttcatcacatagaaaaatgtttccctctttgatgatcttgatggaagaaattttgatttcaggagtgatatcatttggtgaagacaaaagaacaatagctaggctataagtcttgcggtatattggaataaaacttgagattttaagctcacttgagattttaaaaatttcaataaaaaatttaaaacatgacatagtgacgttgggatcactagaactaaaggcattgtcaacaatggcttgaattgattccagacaagattctttttcaataacacatatttgtgcaaagactttacatgaaagtttttgaagagttaaatcagtgctttgagttgcttgggcgatgcattctttgagttcactaataaggttagcttcaaattttatattttgctttaaaatcatactcagagtaaatactgcaaaacactttgttgtataattactatttcatccgagacatccatagactgattttgtattaactcttttactgttttccattgaatataataaattccattcagtgtttctatgtcttgtggattttttttcgtcctatagcaaacaaaaactcatgaaaaacaggatatctttgaaataggttaattctcatgctttcctcttccatttctgtatagttgtcttcaattatttctttttcggtttctaaaatattgttttcattcatttcttcttcttcagatgattaacatcttttcgtttatattctcttcatgtaaatttaaacatgttgctttattgttgtgacctgatcttccacatatactgcatgaataatgttttttctgattatttctccctgaccttcttattaaatttgctggccttgtcctttttcttctagagaataaatttaaatttatatctttaagttcattagatgattttagaacttgttcttgtgatattaatgggatttgcttatctacacgattaataatttcatgaacacaaggaacaccatattcaatctttgtaatacatttgcaattcttctcattaatccatatcaataattcgatattagctcttccatccattatttgttttttagttttcttagtattatcgacttcatttttctatttatctactgctattgaacatttaatattaccttcataaatattattgttaatttctgtaagcattctctcacttagcctagcaaattctgtgaataaattatccaatatatttataacagtatcattatcttttttaccattataatctttcccgtatattaccatttaaaccttcgatcgcattagttgtttattgttctcttaaatttacagacaataagaaactaggatcataacaatcgatatcatcatcaattaatgctcgaatagctcttatgtttttgacagtactccgaatagtttgatttaaggaattaatatatttataacgacttattttaattctcaatgaatttatgagatgacttatatattataaattgaggaccaaatatttgttcaactgatctaatcatatgaactctgcgaaaaacaattatagtatttaacattatctcatcaattgctggattttgtgcttttaatctaacaatgattacgactcttggtatgccaactatattttctatatcatcaaatacgagtttaaatatttccttttctttactttacataattgtaaatgttaatatctgttaattattattatcatcaatgaataataaatttagaataggcatatcgaaatcattgatcatcattatgtcatcgatttgtaatgtatctctagatattattttattatttaacttccttgaaacaaatgttgctgtgataattttattatctgctctgttcaaatttaatatcgtttcataattatttgatgactgatagataatagattggattgatttgattgtgtcaacatcttttgcttttaaataagaacgtctgatatcataaaattttcggacactgacagattatgctattttccttctaatatatgcagcattttctcattgtttagtgtaagttataatttgattgacccaaccaactataatgaaaatctagtgatattggatgtttgtgtcgaaaattgctctcaacaaacataacttttgatcaattatgatcaactttcaatcttataaagctcttgcaatcatattgttttagcgtacggtatttttttaactttgcaacgtcctccaaaacgacaccaaatatctcaatattcgaatggccaaagatatttgtccttgcgagtgaataatgaccaaaattttgcttgaacatttcttgtatatcataaggggaagtctcttgtaagttaatcgacatttcccaatttttaggtaaaacaaaatatataatttctggagtatcaatcgtgtttccattcatctgaacctactgaatcttatgagattatatcaaatttgatgaccggatgaacattttgagaattttgtaatagattgtgaccatttttgagatttttgatgctcatgttggcacttttaattgaaataaaattatcgtgtcgaatacaaaattgacgccacttcgtgtcaattaagaaggggcgacaaagccgtttaaaaaaccgccaggacttatttatcgaatattggtataaataaagaacatgccatcatttaaaatacaatattttgtaaaatattgtcttgaactatataaattgaaatattatctaatattaacatacagatattgagtaagaacaccttttttatttaaatatttattttttacaacattcaatattacatggtttacgcgttacaacatttcaaaagttggaataatcagaatattgataatttttaaaaaacggctgtacaaaattttttaatatcatatattcattgtctatataatgaattcaatcaaatatcttgaaattagagaaatcgtatcgtaacgtttttagatattattatttgaatatatttggtcggacggcgaagcagtttaaaattctaatcagtaacaataagaaaaatttactaaactagttgggaagattcaacatttctttcaatggtagcatatccagttgatgatacaattcttgaatttcttattgatacccattttttatcagtacttatttgaaaatacttatatataatgtcattaaaagaaatttcatcagaaaatttttcatcaattttagaaaataatgttttcatttcagctgaaatcaaactttgatctaattcaaaaattgttgagacttccttgatgtatttagaaatttcaaaatgtaaaatttcttcatctttactaaggaatgccttactatctgaaattcttttagatatttttctgtctttatttggtatgcatatttttttatacattacttgttggcaacatctcataaaatttgttgcactatgattgtaatgacacaaccttataacttggccaaaataatgttcaagccaatgggtaccacaaaagcaccaagatgaatatctttgttttgataaagaatatttgataaagaatatacgagtgacatcactttatcaatagtatatatatcgtatatacacatgtaaggatttttcccttctgacattgagcttgtttgttttcgatctcgtatttttatattataagtttccatataaagatacatcaacgcccaacataatgacaaacattcaattcttcgagttctatttaaatttttatccataacagacttaataagtaatgttgcaggaataagtgatattaacactaatttatttgtttcaaatgctttaaaaatattattatcggtaaataacattattggtagcatatcgtccatctttttactatgacttccatccaaaataaattctgggatgccaacatcaatataatcctttttgttaaacaccaaatctctatcaggtaaaacacaaattgaatttccacatacgattctatacctcatgcattttacaagatggagcatatcttcaaaaacaagaggcatgtttaaatcactgattaaatttggtagaaaacaagaaatattaaaattttgaaatttatcacaaattgatttaacaaactttaaatcaccagtatctccgtcaaatgaaatgccaacaacatttatacccaagccaccaagtaaaattgcaattaattctaattgagatacaatttcattgtcagatgaaccattttcttttacttttatacataaaccaccattttatgaagatattggacatatataatagacgaaataatcgttgataatatcttgtttgttttcatctataaatgataataatgcctctgaagatgatctcaaataagcagctatatctctgtcaatataacattcctccattaaacctataataaatccatcttaatgtataatgacatttgatgatatacaagctgcgtcaactgctagaataacatcatggttattttgggaataattctcatttaaaaacactatcaaaagatgatctttatgttcaatacttccatcaaatacctcttttgtaatatttaactgtttatattcttcattcttccaacgttgaattgttctccaacaagggaatcctaaattgaactccattgacatccataaagactgtcccatattagacatacatatataatcaggtatagcttttttgttgtatctctttgttgaaagagaatcaacatgcatttttaaaaaacagttattttctatactatgcaaaagctcacttctggaatgtaaagactcaatatcttttttcaattttatgttttcttcagataattgcttatatttaaatgaatgtaaattaaatgaagtttttaaatttttgatctcttcttgtaaacgtaaaacttgatatcggagttgagcatcagttgcatcttggagatcattttttcttggcttaaaaccccttgtacatgttggtttcattgaacaactttcttttaacgtcagaaataaacattagaaattcttatcgtacattgaaatatataaataataattttgcaaaatgttacgatataatttcaaaaatatcgaattttggtgaattaatcgatatactgagagtttatttttaaaattactaagaattttgtctataggaaattattgtcgccccttatgtttattaggaattaattagatattccaaatacgatttctcaaaaaaaaatttttctttattttttattatttactgtcaggccaaaggctttggaggggttccaacaaaaacattttcgattcattagggttgtccccaaataggaaataaatgatagcaagtcaaatcaagcctaaggatcattttccatgtgcaataattcttccttttcttcttttgtttttaaaatcttaatgaaatgatgtaaactgtttattcaaaaaaacggctatccgatcaaaatattttgatcggattcgattataatcaattcaaataaaaatttgaataaaattataatatctcaaaagaattcagaagaaattccaaaaatcccatccacacaagtatcacaattgaaatatatttcagttttttctcttgtgtaaattattttcacatcaagtagaaacactaactcattatcgaactaaatttggggcactccaaaatatttgtgaaatgcaaaaagatatccagttaagtcacatatcaaatattgcccaaatattagaaaaggacaatgtaaatggatctatttctctgacatgtgaaaacgggatgttttattttaattggattccatatgatagttctccacaatatcttgtcaatagcatatttaaaaaagtaggaaatgaatctactggactcaacaatggtaagacttttaagacagatttcagacaaatttcacaattccgaattagtgaaaatgatgaagatttaattttaacaattgatttcaataatgcttctgcttccagattctcccttccaaaagacaatatagttgaagtttctaattttatagaagctttattatcaaatcgcattgttgtaccaaatcactataaagaagttaagcacactcttactgtatacaaaaactgcaatcaaaattaccttcttccttatccaacctatattcatttacgaatttacaaatataataacttagatgatttttggcttcaaataacagaattttttattaaccttatgacagagatcgcaaaagattatatcattctccaagatccggcctttccaattgagattgcaacattatcatcacaatacataatagaacaacaaaccaaaactttatagatcaaattccacaatacgaaccaattaacaaaagcaattttgcttctctttttgatgacaacggtaaactcaaagatattgaattatttaaatcacgtattttgtatgctggtgttgaatctgatgtaatcaaagatgtcctaccttttattcttggttcatatccacttgatagtacttcagaagaccgtaaatcacttcgagaaattcaaagcaatcgttttcaacttctccgatctcaagttgacaccataggcacctaccaaatgacacgtaataagaagctaagtagttcattccacgttatctccaacgacgtcagccgtacgaaccgaacacatcctgcatttctcaacaacggttgtatcggcatgtcacttttgacgacacttttgcgaacttattgtttatataattttcaaattggttatcttcaaggaatgaatgatttatttgttccaataatttttgcatattatccaaattggaatgatgaaggaaaacctattggtgaagaaggtcatattttaaatactgatgaacatatatctgatattttttggtgttatgattccatgataaaaagtattaatcacattgaattaattgcggatgtccaaaaacaatgtgtgtctaagtctaaaattgttgttgaaacattatcaaaagtatcgccaatgatatacatatggcttaaacattacgacttaacagcattactatgggtatatcaagactttgttctgttgtataaaagaacatggaataacatttgggacttgtggctaatgttttattcatttgtcgagccaaaagattttttgatttatttcatcgctgcaacaattataaagatattcccgaagttggcgaacattaaggaaaccggaatcacaatgatgatgacgcaattccaattagagttggaaaaggaagacccaaaggaaataggaagaatcgcactttgggtggcgaatgtcgcccctttggatgaatgcgagaatgaaattgttgataatgaaaaaaatgatacaaatttgaaaagagattatcgttttttcgatttgttcaaacagtaaaaataagttaatgtgattaatggtttgttgcttttgtttaaatgtttagcattaagaataatttcattcagtttatgcacttctttatcataattattctgttttttcacttttccaaatttcttttattttctgaaagtaagacctagaaaaaatttaatgtgataaaatccttctactgaaatatatgaagagattattgaaataatactaatatatcaacaaattctgttatataatacgcttctatagtaaaatgtttcttgcttaaaaatacaatgatttaagtacaatttttggaaatttctttctctttttttggattaatttagttatcaaatgcgaaataatctaaattaaaagataaataaattttggatattcaagtcgaatacttgcattgtttgttgaactgttaacgcaatattttcttcatgctattccttttagtaaattcattgtttcaatttttatgggtttataagtattcttaggaaaatcactctttctttccatttattgtatatataaaaataaaatttaaatacataagcaatttgtatttataataaataataaaaaaacaccatttaacatatcaacaaatcatttattacatttacaaaaattaatttcttgtatttgcctcatctgattccgaatctgccaaatagttatcaattgtcaaagaagccaaaccattagcctcatccgtataaattggagtcaatatatcatctttcgcgaacgagaaatcatttaaatgtaccaacgaactatttatcggcgtcaccaaagagtccattggcgtttctccttcgtattcattactacatacgcccatttcattcaaaggaggcacatataatggtcttgtttgcttgttatatactttatcccaatcaattccttcgaagaatttatgtttctttatttcgttaaatccgattcttttctttggatccttttctaacaatccttcgattagtgattgtgcattcggatcaaaatcaggatcaaactcaatctcacttgttaagattcgcttaaacattaaattccgattttgcgaattaaatggtgtatcaccaacaagcatctcatacattaaaattcctagagcccaaaaatcaatctcaaaagaatactcagaatgtgatattacttccggtgctaaatactcattagtaccacaaaatgtactcgtcatgctttggtcaagcaaattcttgcataaaccaaaatctgtcagcttaacgtgcccctgcgcatcaaggagaacgttttcgggttttagatctcgataaatcacgccgaggctgtggaggtaatcaagcgcaagcgagatctccgcaatatacagtttgacttcaggaattggtaatgtcccacattcttgcatatgcttgaaaagctcacctcctggtacaaactctagacaaaaataaaacttggaggatgtctgaaaagcataataaagagagattatgaaaggatgatgacattcagtgagaactttacgttcacaaattgccgtatgaatgcgatcaaaatctataaggcgtttcttatgaactgtcttaatggcataaagttcttctgtatctagtttttgtgctaatgtgattttgccataatatccatgaccaataactgtgattaaacgaaatgaatcaatattgacttgcgacttactgtaagatgaagacctaagtgccataatccatgcatctgctagagaacttgtatcagctcgaaatatataagatttttgattaggtggtttgattctgaattgcttgctattaggtttagtaagggttattgaacataaactatcaatattcactgaaaaaattaatgatttttcatcttcatttttaaaaacaaataaagatgatttcttcaaaattgcataacatctagcccatactctaagggtattttgatattctagaaaccccttcattgagccatttgcataaacaggaacatcttccattacttcgaaagaacgtttggatacaacggtttctcagaatttaacgttcaacttgtttaacatcaaaaaaaacgaaaaaaaaaaatattttaacatttaattaaattctatccaatccgaaaccctctaaaccataacatagaggagccaagtaacaatatgatattatacaaattgaaatcaacaatgtagagaaacaactttttgcagttttaaacttttcaagcaccaaatcgatcacaacgcccaaagacaacactgcgaacaaataagggatcaagtaatgataagcatacaccgaatgctttacgaacataaaaggcaataaacttgcgaaataaccaaaaggccaaattatcacctttaaaatgctttggttattatttaacaattctccaatacatataataactaaagttacgattgcgaacaaagcggaaaacattgtaattggattcgcatgtaacaaaacaacagagttcggagtgagacaataaataatacttttcatttgaataaatggccattgataccatttcgatgttatatttgtttcgttttgtttccgtttcatattcatcaaatgagaaacttttaaatattcgaaaattcgcgaaatgatcgaaaggttcgaattaaaaagagaacttctctgtatctctattggatatgtttgttgtatttcagggtttggatatttagttataataatatgaagaataaatataagaaaaaacaatggaaaaacaattattaacatcaaaaaaagtcgaaatagaaattctttaatccttttattgaaaagaacatttttgatggtcctttcatcattatctggctggaaaatagatttaagattacattgtgtaatgtctaaaagttgttgtagtaaaataaatggaataagacttaatgatgtgtatttgatcgaaaatgataaacacgtggaaacagctgtaaagatgatgtgtggtatagttgggttctgtgataacaaagaaactgaaaaaatcgataacattgtgaagaaatgtaaaatgccatctgtcaaaataaagcgcccttcaataataagcatcgattcaaggcatagaaaaacagctgtgacagaagacgcaaatttggaatagccaaaaaaacgaagtgtgagaaatcctaaagatggaacaaatgatgaaaatgatgatactgttaaacgaagtgtaaaataatgaagattttgatagccttcatacgattgataaaaattgattgacccattatatccactgattttgccaacaaatgagagaagaagtttagcaaaatatggatgaatatcaaaatataatttacgtgtaagataataatttgtgaaattcccaaaccaaatctcgtcaaaagttgtttgacttggtttggataaattaaatgtacgggtgcacacaccaaaaaaaataaaaattagaagtaagataatgtcgctcaaagaaaatgaaaacgttggcttcggaacatatatagaaccaaaaaagagaagcttttttttgactttttgttctcctatcattacatgaaatgtgaattgaaaacatttgaaaataaacgttcgttaagtatggcgaaagataatttagtcaccactcgccttaaaaatacaaaatccaaatttatttgactatctgtaatgttgaaatgaaaaacaaaaatgttgcgaacttttagttgactttttgtgaattatctgcaaatttcactataaacaaattgttctttggtttgatttaacaccacatttatgaaccaccaacatcattttttaatgatatacaatatccataaaagacacatatggttaaataatttgtttgatttagttgtaaaaaattcgccattttcatcaagtctagactttgttctgaatatatatcacgaccaaaaattcgacattcattatttcctatagcgtttttatcatgctggaaaaatgcttcacaatcagatgaagatcatttctcatcaattgttaatcatatattgtttgaacacgagaaagttaattagttttttatggatttaatacaattaacacatcgttcattattaccattaaatgttgattatatacttgtagcagaattaagtgaatcgttacaattttcattatatatattacaaagaatgtacatacaagatcctaaaaatcgtaaagttatggagttattaatgaacattagtattaaaatggatcgaattccaatagttcgaagtttatttaataaagcagaatcagaaatgaataaattcgaaatcgctaatttgcatccgccgcttcacacatcaatgacaacaattgatccaaaatttgtatctaaatatatcatttaataagtttcagatatgaacgatcactaacattattgtgtacgcaattatcttcatccgttgcaaatttcggaatatgttttatttttcgctttgcatagctccggatgcgttgagtccgcataatagaaatggattgtttcgtcttccactgcgaatatttgcttatttctcattattacgcctggtattttccttacgtcgtggtgatgcaagaacacgagtttgttgattgggcaatggtacatcgggcattgatcgtgtctcgttgggtgctgttcttctgggcattgttttaagtcattgaaatcattttttttgattctatctaagtcgctttttgggaatggatgtccggagaatgcgtatgaagtagcattcttcattgaaagattcaatctaaatatgaattcatcatgacaaacatcttctgctcttttacagttgaatataatttcttcatacattggaagcattaattcgacagctcttcgcgaatagaaatatccagcgccgccttgaaggaacccgagataatcaatgtgacgaatacagcagcctttaatgactacatcttttaatggatcatatttcttttcgattgcatcataaaatgaatctaatcgctttaggttaatgccagtatcatctgtggtgcgatgaagccatctataatttgtctcgtaataaaaatatgaaagtccaaaatatgttttgcggaaaatgtcaacgctctttttgttatatgaaccatttgtggtgatattcgatgttatgtttcgataacgttctggtacagcaagatgtaaaatatcatctttgttatcttgttccgttttgtttgttttcttccaatcaagataaagcgctttgtatccagatttttgatttaaatcattgacatagaatcgagacatgtttaaggggattgtactatttggcatcgtgataataagaaataatatcctgggagaagtgtcggtcggaacataatatttgatttcgccgttttcagagttacttcttaatgttgctactaaaaagataacaaacattatacattctgatataatatggatattatttcttagtatttcttgtatttccattttttggtgtctttggagttggccaatttggttggattggaactaggctacaaagtattgaaaacaatggtttaccacaaacgattgtattgattaagtaataagttttaatgtatacatttcaatgaaaaagttaataacccctcacaaatccaacggttgggttgccaaaaactaaaaaatgactttttcacatgaatgcattgaatcattgaatacatatacaaacttttgaacgagtgaagccggttggcttgcggttccctttcggtttatttttctcataaatctctgaaatattaagtaatccctcaataattgagtgcatgatcagcaaatttgcaaattttttcaattgaaaaaatccaaaaagtgtcaacgagatgtcatttgtcaaagatgacgtctgatatcaggaaggatggaatggaatatttcttgctaaattgacacaagacacaaccgagaagagttttggattaccatttaataacttttgaaaaatttccaactaattatatagcatgctttttgaaacttggtaaatattttagacacaatttagaagggttccagtaaagtgttttgagcttcttctaccgaatgctttctattattattcgaacatggaagagaattgtatgttaagcctactacacatcgtaacggtttttttaatgattaccaaaacgatcaatttcaacacaatttgccgtttgacaatgataagcaaattcaatgtgctataaaaaacattccttccttccatagttgctaaaattatttttcttgaagatgcttggcccatctttaatgaatcttctttcttcatccttaaattattttgtcttccatatgcaaaatttcaagaaatcacttgatttagtgattattgttatagcaacatcatcatgatgcagtacttgtttggcttaacttttatggtggaaatgaagtttttaattgttttaatttcgtattttcatagttttttatttttgattttctcttcattttctgtcttgcttagttgttgaaatattcactgttgacaatttgttggaaagtttgagaatacgcaagtaaatcgcatatatcaactgtattggaatgttatctgaccatttaattttcatcgttacgtatcttaatttttatcaaaaatctgcgcattacagaaacaacaataacaaacatttttctagcgaataaccacccacaatagaacgttttacaatgacaaaacatttacataaaaacgcgttccttataattccttaatccaataagtgcctttgcaatcgaactctccccgtcgcagcccgccttcttccctaatatcttcaacagctcttcatatatctttatcatcctctgcaacgcgacattcgcactcgttgcggcgcatattgccaacccttttccttcgtacggcgcaccgaagaactgtatcctaaatccgactctgttcagcaagtcgaacatgaatcctttgttaaagagacattgcttcgtttcgtttatgctcatcatcgctaaccccggatgacttatttggctttgaacaatagcgaatcgtttaaatgttttttctgttgttttaatgttatttaacaataacattttgtttcgttgagaatcaaaacctgcgcataacgtaaaatatgctgtgtacaatgagttaggatacgaattaagtcgaatgtcatagccaatgagtcgaatttcgttctcttcgacatatgaaagaaaatcaatgatgacataacctaaaacacctttccgcataagaactgagccaacttgtctggagagaccaataagatgagttccatcaacagagatggatggtataagaattgatgaaaatgaaaatggtgaatgatgaattcgatcaaatgttccaattactcgaatttcgttccctgtaagtagaagtgaaacagatggaaagcttcggatatttggtggaatagcttcaatggttgcaccaagttgtttaatctgtgaaatgaaattatttgatgaaattgaagaatgaatttttttcagatcacgaaaatctttcgcatcaaaccatgcaacaccggtttttggtgtagaataactgagtcgtataatccaaaccttgatatcatcattatcttcaatcaaatcttgcgtatcgtcgagtaaagcactcaaatcttgatgctcttttgtggaaataagaggaacaattccagcctctctaaataaggatttgatcactgatcgtctttgaaaagaggtgggatcaatgcacccaagaataggaagattgatatcaacagaaattgtagattcaattgaccagtcttgatgggggataagaaatgcatctctaccacatattattttacgaacttgttgaatagatttcatgtcacgaagtaattgttgggaaacacttgaattttggcgaagaacaacaaaatgaattctagaatttgtgtcatcaattccagactgagagaaaagatcaagcatttcttcccatacatgttcagatggtaaagaaggaagcaaaagaataagagttacatttttgaacattaaatcaaagcatcttgtcagatcttgtaaccctgttataacatgaacaattaaatatggagctttttctatttctttatattttccacgaagaagattttgaagttgttcggctcgattgctaactgttcttaaacggcttctaatctctgctcgaaaccgtttatttacgtttaaatttctccagaaattttgaatggtaaaagcggctttaaaaatttcttttctcttttttctttccatgttttctaaatattttcttatacatttctgaattgtatatgcagcatatgatttcttttgttcaacaagttcgtcaattccattaagacattcatatatattgtcatctgtgataacattaagaagtgcagcttcactaagtttgcgtccattaacttccgcaaattgaatgccaaatttgtcacagtaagcttcaattcggttaagaactgtttcaatacggttccatatttcattatttgttcttttaaatgactcgaaatctggcgtttctcgagggatcttaccttttattacaaggagagtttgttgggcatatttatcttgaagttcttcatagattcttggagctttatattcatttgatccaacataaatactatctgtactcgttgagtagctcaatgcactctgtgaggaaatagaagaagcgttactactagctctttgaagagatttgcgtttttctgtgagttgtttaaattgagaatctgtaaaaattcttttttgtcgtctttctctccgagctatggcagcaccttgtatatccatatggatcataggagacactattgtgttttgttgatctgttgggtcaatatgcccagtaacaattggcaagtcattatttaaatttgataattgttgataccttttatcagattctgtggtaattttgtttataactgcatatcttttcctgaggtttgatgaatgtgtacttttaaaaggatgatattctcgtggctttgtattaatcggtttctgtatttttgttttgcttcgaggacttaacaactttggagccaccaaaggttcattgttttttgatatgctaattgattcagttttaacttttaaattatttgttgtttcagataatttcgataaaacatttgaatattcgactcctggagtttgtagtgatttttttatctcagaaaattgttggtgtgcattcaaaataacatttgctaaagtgtttttttctccatcagccatcaactcttcaaaccctttttcataacgtatgtgtcacttttcttataaacggtcattcaaaaacgatgttttggaaaaccgttatataaagcagatgaaaactaataacttttttgaaagaaattgaatagtttattgatacagggtttgagtgtgagtaaccccttcaactgctacagcattctgtaaacttctcatttttgaatagcggcattttttttgatttatcgtcaatcggttcacattgttatgaatcaatttgctgaagcagaagtatctcatcttataaatgacctcagtatgtttaaaacaaccaatgcaaatatatcaagtggggcatttcgtgttgataaaggaattattaattacactgaacaatttgttgcaatgaaaagagcccaaaccgaagatgcatataattcactcataaacgaatttaaagtattatgtaaaatatcaaatgtaacagtgcaatctttggttgggttttatccaaatgatgaccataaaaaagctgttttgatcactccattttataagaatggaaatttacgtaatgttattaatacacaaccatctgaatggaccttggatacaaaaataattgtttttttaggtgtttcttatgggttaaaatatcttcacgaaaatgacatcattcatcatgatctaacagttgataatatatttattgatgataatttccatccaattattggtggttttggacttacgcataaatcaattgaaccagactcagtttcaaaagctcgatatcttgcacctgaaattatcaatggagaaaaatacactaaaaagactgacgtatatacatttggacttctcatgaatgaagtattttcttccaaacaaccttatgaaggccttaatattcaacgaattaaagaaaatattaataatggcgtattacctgaaatttcgggtacaacaccaccagtttttgtatctttaattaaaaaatgtctttctaaagatcctaaaaagagatgcaaatcaaaaaagttatttaataagattcgaagcatatatgatgaaatttccggtattaatagatcaattcttgacaattataaaaatcaaataatatattcagaactatttccatttaataattttgttataccaacaccattaacagatattaaatccaatcctcatccatgggataaaacatctaaatatcctattttaattaagaactttgaatcaaccctacgtaaagcaggaaatagacctatagttttagtaatgttatttggaccatatcaatcaggtaaatcaacatatcttaagacacttacagggaatggagcattttatgccggaaaaggaacaaaaaaagtcaaactcaaggcatactaattgatggaccttatatcatttctgatataataaatagatttagtaaagattatgcgaaactaaaagaaaaatgtgattcaattaatgtcgataaaaatacagcaatatttttcattgattcacaaggtattggtgatgaaaagtatgaattaaagcttaagccaatattagataaagttaatgcagtctttacttcaatttctactgtatgtttaactatatctaggtttaatgataaagttgatgattttaaaagtactttaacaacaattcgtcgtgcacaactttcttcttcatttcctttatcgaatgtttttttccttgtaagagatttcaaagatttagaacagaatttagatcaaagaaatccagataaatatcaagataattttaagaatttttctgagttatggtggaaagaacataacatagcaaaagaactttattcgccaaattcattaaaacctttacctcttggggatgttgaagccaatttaagtggatatattaatagtgtctatcaatcattttactttattttaaattctattcaatcagtacaatattttcctgatcagtttataaattcaatacaaaatgaatcatatccattattttcaaatgattttcaaaattttatggatttaatactcaaattcgaaaaagaatttatattaaaaatacctaataaaccattagcagattgtgtagcatgtacatttttacttaatgatcttataggaaaaaaattgaaaattgatactgatccatctaaaattgatgaattaactgatgaggtatataaatttatatgcatagttttagaaactatattaccatatattcttggtaatgctgaagttaagttttgtgattatgctcaatatgtaacagaaattaaacgtgatttgaaagcttctattggaataaatattcaatatatgaagtcaaagataaaacaatatcaatattttagagcaaataagtggaaattaagaatgaaatatattgcagctgcaacattcattggagtgggtttttcttttgcaggaggagttgcagcaggtattattgctgttgcttttgaatcttatataagcaacgcattacgattatctgatgagcaaataaaagaaataattaataatgtgaagacaccattttatccatatatttgggatatttgctataatcgaaaagcaaatgagttaattatttatcaaattataaagaaaccaattacacaaaatcagacattaattgtattttatgaacaaccaaatcatcattcagaacttttgtttcaatcattaaccggattccaaattaagcacaacattgaaaaacaaatattattttatgaaaatgtttattccatttatcttatatcaagatttaaaagtgttgattcttctctttttatacgtaataagaaagtaacaaaactactagaaaaaattagtataatatacatgtgtggaattactcaagatgaattttgggaatttgaaaaatcccaaaatgttgaattaatatttgtaacaacaattaaaaaagatgaacaaattagtataaagccatctatattaaaaaagttaaatgtaatgacactttcaactgattattatcaattttctattgttgataaaccgaattttaaatatgaaatgtggaaaactaacaaattctcaaatgagaataatcaaattaaatttttaccaattcatgcaggtgattatcaacttgaaaattatggtccgagatgcatagcttcaatcaaatatgcatgtagatacatattaaaggatccaatattaaaaccaacagttgaagaaattcaagaatacgaaaaaaatcaagctaattaataagttaattagtaaaaagtcctaaaaaaaattttttttaacccccttacaaacttacataaaaaaatgaactttgtttgaacaaatatgaactcaaaatcatatcggcacaaaagccacttttttattgaatttttgtgtaatttgcttaaaaatgcacttttcattcacataacatcagcatagaaaatttgtctaatgattattgctcaaaggagagatctctcttccattggtagtaggcatcgaacaagaaaaataaaaccacacgccttaaatttaatgtctacgttttaaaaacacgataaattttattattttttgctttcacaaaaaagtttttatttaaatatcagtacatatatgtatttggttcttgttcgatcacttccggatgtctcttaaagaagtcaccccatgactcatagcttgatccttgttgatcatagatataattcccctgttgtgcttcaacagtcggcacattatatattcgatactcgctgccatttttcatgtgcagcaccaaacaatttggcattgtatcactaaaacttccgtaaaatccattttgaggataatcattcgaaaaaaatagccaactcccagtgctgttagaatactctaacaatgatgctatcttgatcataacagttcggcgaggcccgaacattgcaagaaatttgataaaatctgatttttcaattattgattgatcatttcgagatggtgaaattaaggcttgaagaacactctctgcattgtcaatgggttgcatgttctgttttagcatgttagctgctctatgaataaattctgtcgcattgaatgattcacattgatatcctacaatttcttcccataaactctgtgagctgacaaagaaattacgaatgaagtcatcattaactgcaaaaggtaacccaatggtaaaatgataagctaaattttgtgatgatggaggatttggattttcattgataactgtaggcattaaagatggacttttctttgtaaatccttctttagtccattgggtccacccatctttatcgcgttgaagttgtatgaattttaaatctttaagatttacatttaaagtgttaattttgatacccataacttcaaccaatatctttttgttcattcggaatttttcatttgtaatccaaccaacacctaattcttcttcagttgaaggattattcataacataagtaagtaaaacatgtaatttagttgtgaattgagacgaaggatcacgactacttttgcgtctgagtattttttgaatatttggcggaagtttcatgaatgctgtgagggtttttgagtagttctccattaaaatttggcttgttgggtgacctgaaatttacttcacattttgaatacgttacgtagaaaaacggcgacaaaacgatcgtaacacgttcaattcttctcagaaaattcttttgtataaattcaaatgccatcaccaaaaaattaatttccttatgctcatcatatctttttattatacaagcacaatgaaatgattaagtaatgtagagtgtttgtcgattctgatgaaaatattaatttttcgatattcttctcgatgaacttctaacaagttaatattttcatgatttaattgatatagcatataaaaatatatttagcaattggtgtcattcgcatgattataacgaaatttgagaatttttactgaaacattctttcatgactcaggcgtaaagttacggttatgattcaatgactactctcaaaagtctgcggcagttttcattcaatttccgtggctggatgcgagcggttttgtctgaccactaagatagatgcgtggtaagtggttgaagaagcgtatgcggagactcaaaagaaagaggaggcaaatgagagccaaggctaggtaaaaacataaaccattataaaaataaagttagtaaatctttattgacattaaaaaatacttcttttttaaccaatattttacagcaattacgtcttttcccacaagttaaccaagacttgaaataaagttttggtgcattgaaatatagtaataattcacaaatcatatatatgtttgaatcagagaaatcaaaacatataacacaaaacttatagctttaacagtatgtccatttttagattcaaaaattttgaattaaatgttcagcattaattgttcatttattcatttgaaatttctatttgaggccaacaaggttcaatttgaatgagacatatgggtgatactctgattcatcgttcatcaaatcatcgtcagctgcatcgtcggtctgaattccatcattgaacaccttctcgagctctttgtggatcttagggatgttctttggcaaggcgcaaacttggaaggcctggaagtcagatttaattccatacaaaagaattgattcaacgaagattctgatagctttaatatgcatccatactattgcaagttgagaaaatgttgattggagttgctctgagtaattattagattcattcagataattttgaattgcttcttgtgcctccttttggagttcttcacgaagattcggattgtatgtgaagtccttgatatgccagcccttttctttagtggcactcttgtaatcatcaagattcttgtaaatgattgtaacggcaaaacatgtgtactcattatcagaagcaagctcttccaatgagtttggaacaacataaggactgtcaagagtgtaattattcttaaattcattaacatatccattcttgacaacaactaaaacagtgctaaggttacgtgtgtgtacatatatgggtgtctttgttgctttggatgcatgatattcatcaagatttgtaactgaatacattgaagatccaatttcatcaagattacgaacaagaagacttccttcactcctcctacgaaggtttataatcttattgccggcatctgtgaaagctgtgctcgagtttctaatttgttcatcaagtgattgaacttcatctaaaagtgttttataaatttcaacaacggaacctttttgtgagaattggatatcgttccattcccatccttcaatatattggtcaattggaatttcatcaatttgatttccgttttgaagtgaaacaacaagctttggtggaatagctgggtcaaaagcacagttgcatgggagatcatcccagcctctttgattatcagcttgaatcttttttgataaatcagagcaacttctagcaacacgagtgagaagactaaacgcttgaaggtcgagttttccaacctcatcagcaatggacattaactgatcagttgaagaaaattctgttaaatttgatgagactgggaattggtgaaccttacctaatgaaccaacaattccttcaatgactttgttgatgcttgtatcttttacttgtggtggtaattccttagaaaaggaaagaagcaagtattgtgccattggaaataatgaagcatacgaacaaagcttgtcaaattttcttatcatttgttggccgaggggctgaaaaccatgtaaagcattcaacgatgttatcatcaaaaagagggtaaagaaaaatggaattctacataaataaaaccaaaataaactttatgttcatatattagttattcattcctttatccgttctttcatttttttggtattaactcggaaaacaaaataatttcattaaatacaaatgttcagaaatgaaacttttcaaataatttttcaatgtaatttcatttcatatgcgataatattcaatatatgattaaatcatgggaatacaaaacatgttttagtatggaacaataaaaaaacggtcgatagaacgttaaataaaaatatggagaacgtttattcagcaatatgccaaaggaagacctcaaagaatcatacataagtatgtttaaattttaacaccagaatcatttcaaagttgcgttgatacaacatgttgtaatattttggcatatgatcatgtttctaaaacaaatcgtcatgggaaaaccgatcacagatttttagtaataacaacctcatcaatgtacctatgtgtaggttttaaaatgttaaaagctgttaaaatttcgggtatttttccatgggttaatttaatacaaataatttacaatgcaccatcactttctaatccattatttcatcatcttctttttgtttttaaggataagccaattcgtcttctttccgttaatccaggacctattcttgaaaaaacaatcattaatttatatcaattatttggacctgacccaccaatccacattgaaacaactcccctagacttttcatcggaatccaaacaacctttttatttttgtaatttatttgcttcttattgcatatcaaatgaattatcaataaatgagcaaatctatcatatgcttgaatcgatccaaaacgaagctgaagaatctaaagaagggatgatagttaatgtacaacgtcttaaaagtgatcccaagtatacatttccacttttaacagctctttatcgctcacgaaacatttctaatttaattatttctggtaatgatgtacaaagtttttttgattacatcaatgtagttatcgagaacaataaggacacacttaattcgctcacgattgatgggtgtaacacgttaaccaatattgaattaatgtataaagcactcatttcgtcgaacgttaactttctatcgttcaaaaacgtcacttttaccgacacattcataaaaccgtttattgaatttatgggtaaatcacttgtatcacaaatatcatttgtccgatgtaagtttgcggatggcacatttaaagaattttcaaatcattctaatgaatttaaagacatggactcattaataatttcacatacaaattcacttaagaataatgaaacgtttttagatctttttaactttattttttccataaaattaccaaacttatcattaattgatattgggacagatattacaatgatatttgatatattaaattctaaatcaataccattgatatcattagatttatcatataataaatgcaccaattttaatggccgatgtaatttaccaataacattagcggagttaaaactttcacatgtacaatgggatataaatagtttatataatattttagattcacaaaaatttgtcacgaaaatatcattaaatgtatcatcaattgtcggcacgacatttaatgacatcaaatatttaaagcctaaaaaatcgagttattcaatcaaggaattttattggaaaaacaacacaataaattccgtttttatcgaattcatttctaatcttccgaatttggagtcattaggtatcgatggatgcgaaatcgaaaacaacttaaatgatccgataatgagcaaaatcgttacattccttcaaaactgtaaattaaaaaaactttcaatgtgtggaacaaaaattagaaactaccaaaataaaattcaagaattctttgggtctttcgctacttcaacgaccttagaatcaatatcgatcagtaagaataacatcggcgataaaggtttggaaagttttgtcgaagtttgcgcaaagaacaatttgattaagtctgtaaacttctcaaaaaataactttcagaatcctctgaaattcattgaatgctgtaaccgcctctctgaaattaaccacctcgaatacgttacaaaatcgaaaaaagatttatcaaaattatatcataatgctcaaaaatttggagttgatccaagtaaaattagtgcggcttggaaaaacttacaagaaaaattaaaaaataatcgattaaaaaatgaaaacgtttataactcagattctattttgattcaagatggaaattatcaaaagtcacatatagcaaagcaaacagcttcgtgggaaatgacgattttggtgccttataataaacagccaagtcaatgggaagaattaagaaaaaacttttcactcgaaaacttgactggatttccaccagatgaaacagattcgttaattgatttgtaagaattgtaatttttaaataaacaagtgtgtgaaaaattattgtcaattttaatttccttataaaaattcatggcacttttcggatgtgagcatttcttgttcagaaattcccaaaaggaattgattctaatgtaaattgatgcatttaataaattcaacaatgaaaagaaataaaaatttgatgaatctatgtgtagtatttttaaaattcggaaaaggtaagtttatatttgaatataagttaacacctataaataagataatgcattataggtagttatataattaaaaatggtagaatcatattccaaacgtaaaatctattgatacttttattcaaaattttccatattattacaaatcagttatactttggtattaattttttcaaattggaaaattataaaaatgaatatacacatatttaataatcatcaaatcatagtacaaagtatggacatggcttcatcttcatcattgttacacataaataagacttgggatattacaaataaactcaacactccattaaatttctttaaaattttatcactgattttgatcttttctttgtcttcatccttagaatgatttacatttttttctaatagaagaagagctgcattgttaaggttaccatatgcgctttggagagctttcctacaatcttcatctgacgcatctttaattataaactttaatttactgatttttctttcaatgggatcacctttagcattacttatcagtttatattgcccaattgtgttgttgtcttgtttaattacttgatcagctgtactcattaaacaaaaatgatttcgttggcagttgcataaaatattcagcgaatatattttgacacggcaaaagttgtttgacttgtcaaaagattctgtgccgatatataaccgacgctttatcgtcagcggtttcagtaacatttttttcatgctaaatcaagataaaagattaaatacttttagttttgaagaaactcaacaacacaaaaatcaatttttatcatatgcccttaaattatatcatatattattttatttcaaagaggagaatatcaaaaaatcacttgatttgatcataaaattagatgatggtacatattcttttacggaaatgctttgctatttaattttttcttctttccaatcacgcaaaattgatatcatgacatgtattcatataattaaggaaattaaaatagatgaagaaaataagaatcgtaaatcacaaataatttatgtattcacaacaattcttctaaggtcaaaaatccgagaatcgaattttcttcttgaagaaatgataaaatataatttaatcgattcaaaaactgttcaaattaggaaatctttattatatgcacaccgcatgttacactataaaatgtcaaaattggaatacgtagatccattttgggaggaattttttaataattatgatgaactttcaaagaatgattgggaattacatatgaaattaattgaagaaggacaaaatccgaatgaaattgcgaaaataattcgaaatgatgaaatagaaaaacttcaagaaatatcatctcaaaataattttaattttaatcaaacaattaaaccatcactttatgaaagatgttcattcattaatcaaagaaatgtttcattaattgattatgcagcattttttggatctgttaaatgttttaaatatttacttatgaatggtgcaaatgtaaacaatactggaaaatatgcagttgcaggtggaaatgaagaaattattcatttatgcgaacaaaatcattcatcatttgaagatgcatatgaaacagcaattgaatttcatcaaaaagaaatctttttttatctttttgaaaaaaagatacagaaaatagatttagaagaattaggaacaaaatgtgttttatataataactatgaagtgttatcttttttgataaagaattccctaaaaattaatgataaacttattttagaatttgcatcacatggttttatatatatatttaaggaacttcatttgggaattaatttgccaagatttatattgacttattcagttttatcaggaaatattgagcttgttaaatatgttcttgagcaaaaagatattgagattaatattcaaaatgatttttgttttgataatttaaaatctaaaaataatgtttcaaatttatataatatatttaaaacggcactgataatagcatctaaaagaggttatagcgaaattgttaaattacttcttgaacaaaaagatattgatgttaatgctaaagatatttatttgttatatttgctatttgtttagataatttaattttttaaaataatatttggaaatggtttaaattatttagaacagcactttattatgcatctcaaaatggtcatatcgaaacagtcaaattacttcttgaacaaaaagatattgatgttaatgctaaagatatttatttgttatatatgatatttgtttagataattttattttttaaaatattttttggaaatgatttaatttatataaaacagcaattatgagagcatcgagtaatggccatgttgaaatagtgaaattacttcttgaacgaaaaggagttgatgttaatgatagtgatattaatttgtttagtttaatgtttgattttatgatttgaaattctcaaatattactccaagtttgtcaaaatgatttaatacaccacttaaatgtgcagcaagcaataatcgttttgaagttgttcaattacttcttgaacaaaagggaattgatatcaatatccaaggtattaatttgttctattttataatagttttaatctttttgggttaaagcataatatttggaaattatttaaattttttgatacggcacttattaaagcatctaaaaaaggttacacagaaattgttaaattactattagaacaagaaggaattgatataaataataaaaatattattgatttttattagatgtttgtttaagtgataagatgttttaaagtaataattggaatatgtttgaaatctttggtacagcattaatttatgcatcagagtttggttatgcagaaattgttaaattactattagaacaagaaggaattgatataaataatgaaaatattattgatttttattagatgtttgtttaagtgataaaatgttttaaagtaataataggaatatgtttgaattctttggtacagcattaatatatgcatcagagtttggttatgcagaaattgttaaattaattcttgaaaaacaaaaaaatagtgtcaataattataacatttatttattttatgttggatttattttaactatttgaaatttctatatattaattgacatttattataattatttagtaaagcacttataatggcatctcactatggtcacatcgaagttgttaaattacttcttgaacaagaaaaaaattttattaatttaggagatgttttttagtgttattaaaaattcatttacaaaaattcatatttcatagcaatatttggaaattattgtaaatatttaaaacagcacttatgtttgcagcagaaaatggtcatctagaaattgttaaattacttcttaaacaagcaaaaattcgtgttggcttaaaagatgtttgtatgttttatttaaaatttatttcaataaaataatatttcaatataatatataaaatttattcatgaaattttgtactgctcttatgtatgcatctaaaaataagcacctcgaaattgtagaattacttaaaaattttcaagttggttagtaaagttttagatattaatcaaaattatgcaaatcatattttgtcttctaatattattaaaaatataatgttatttaaatttcaaattccactttgtgaataaattttatatgcatacactctttcaattaatatagttttattatactattacacttaatgatactattactctgaataaaaagcattctgagaagatgaaaataatattttaattatttctttattttcaaagtttcatcattaccaaacaactttaaacatatggaaacgcattttctatttgattttggacagtaaacgagaagtattattgcgatgcatcaaattaaaaattcgatttttattaaaaatatattaaatccaaaatgacacattttaatcagaaaaagcgatattaaacctcactgccaccaaaatgaccaaacaaacagtggccaagacaatgaacaatctctttaagtatgggctcaacaacactttcagcaattcttgttctttctcagatgtctgattctttaccattctgagagaattctttgcgatgataaaccatttcaaaggtttcgctaatattgcaattttcggtggcattacttccaccgcttgaatccattccaatgattcttcgagtggtgatttcatgattagccatagtaatgatttagcatcaccttctctgaccaatctcattttctctatagtttcatctgtttcggcattttcagttgccgaatattccatatttgatatctccaacaaattcctaatggcttcattttgtggttcaattttaacccatttaattggtgttagcttcatatcaagcattttaagaaatgcatgtttagatcctctttcaacatatttatcaaagaataatgaccatggtccaacgtcaataattcttcgtaacatagaaagagctgcttggcaatcaacagttaccccatcgccgccgagtaactgttgtgcagcatcaaacatcgaaggagcgaaacctttagtagccgcctttttgaatagtttatatccttctgtattactacggggcactccgagtaaaccatagtaagtgatttggccaagtttatggattgctggaggataatctgtacgtgctgcgtcttttacatatttatatgccttttgtaattgcattggatcgtttcttcctatggtcatgtataaatctgaggctaataataaagcttcaggatctttaatttttatggctgagcgaagaaatgataatattttgctggtgttttgcggcttacgaataagttgaattcgtgcaatggctgacgctgattgtaaatgaccttgttgtaatgctttcttaaatttgcttttggctgagcgatattcactacgagatggataaaagacagacatctcatgaagtccaagtttgtataggtctttgggatcagtggaattaattaagcgatcaacttcgctttgatttaggggtgtagatgtgggaaatgctttcatttgtgtacaaagactagagatgtcaacaagaagttgagatgctgtgggacatgataaaggtcgcaaaaaacctttttcatattggaatgaagaagataataatgactcaactgattcagctgttgaatcagtttcaacaatagaaacaggtatgtcaacgtcataatatctgtgataaaaagaaagtggaataagagcgtttttatcaccgtaatctagagctttttgataatatgaaaatgcttttttatggttttcttcggttccataagcaccaaactcataaattctacctagaataaggcatgcttgtcctgttttgtttctacaagctgttcgtaattgataaaatgaatatgatacattagttttaagatttaaatcattaaggattttatatcccataaatgatgaattattttgtatgatacttaaaaaatcgccaaatattatctgtgaatttattttggatgatgaatgaactagaccaaaaattggaggtactggtaaatagtttgggtcattcattcgtaaacctgttttccaaggtgcatttgattgccatatagcaaccaaaaaagctaaatacattctgttattcggccaattaacttggagattaacggtcattaacattgacgaacgttaaaaaatacgttttctatatttcaaagaaaaaaaatgaagatccaagttctgtcaaaaacagatgcaagttcattaacaggacttaatggaatggtagctgctctttgtcatgacgataagtatttctattcagcagtagatggaggagcaattaggaaatatttaatgaattctgatgatcttccacaaacatctgatgatatttttacattaaagaaatcacatataacatgtttagattgtacacatgatcaaggagctccaaatactttttttattggctgctctgatggaaactttcatttatgttcttcaaattggagaattgaaaaaacagttcaagcacataatggtgggattacctgtctttgcgtaaatcctgatggtgcttcaattgcttctgctggtgaagatggaataatcaaaatatggagtcgaaatggaatattaagatccacattagcaagttgtggggcagccgtcacatctatgaattgggattgtacaggaaaatatttaatgtttacacatggtggaatgataactgttcgatcagcatcatttaaacaagatcaaacacaatttagaggtcatcggagactaattacatgcagtgattggaacaaagccacaaatgagatcatcacaggaagtgaagatcgcattgctagaatctttgatcctgatggacgaatgatagttgaatccgcacaattcgattatgctgttaccacagtacgctttctttcatctataaagcttattcttattggtacagctcatcatttatatcttacagatcttcagcttcggataattaatacccttccgcttgcttctggagctgctatttgcgtaatggatgatcaaccacgtgctatagttggcggaaatggaacactttcgttaatatcaattatagggaaaaaagcattttatcgagattgtgaagttttcatggaatctcccaaaaaacttattgtttatgatcttaagaatggcatcacagaaaaccttcaattttcgacttcggttgtagacttttatttagcatttgatcatttaattgttgttttacaaaacaaaattcacatttataaatcaagtcaatggagcactccgtctatcgtcgatacaaaagaaaccgctagagcacttttgcaatcgcaaacgatttttgtttacataaccgttgctggcgctcaagttatcggttacgatggaagacctatttcaaggataaatgattctcgtattaaatgggatttattatcacttgacttggtttcattgtcaccatgcgttttggctgttgtctcacctgatgatcgaaaacatgtttttgcattttcggcatcaactggtcaaatgattacagctgaaccattaaaccacccttctgaaattaaaaacattcgtactaatcaagctactacacaaaacaaagcaagaattggtctattaaattcaaatggagatttaacaatttgtcgttttgtttctgcaaactcacgttctatgaccatagaatcccaaaaactagccaattttattgatgaatttcaatggcatacatcacatgatgttatcttagcacgtagtgataaaactcttacagtttggtgttgcccgaatgccatattctttacgcccgaactaatgcccatgctcaaaaccgagctccgattattatttgatgtatctgaaatcacttcatttgatggaacgcatgcatttgttacctccaaagatggctcgctatgtgtagctcccatttcaccatatcttatcatggttcatgaagccattgacattcataagaattggaaattagttcttcaaatctgtcgatctgcaaacgaccaaagcctttgggctgtctgcgctgcatgtgccatacaatctggcgaaattgacgctgctcaagaatcatatgcagtattgtcgctcattgacaaagttatgtttctcgagaaagttaaaaagatgcaaagccccgcagcacgtaacgcgatgattgccgtgttgcaaggccgcgtgaacgaagcagagggaattcttttgcagggaagatgcatattccgagcaataaagttaaacatcgaactcggaagatgggaacacgcattagacatagcgaagacacataataagtacgtcgaagttgttgccgcttatagaacaaagttcttgaaagatatggatatggaggaaactgaccaaaactttattaagattggacaagtcgatatggaaagcattaaggatgtgctgaaaaaggtaaagagtgaggaaaatgagtaaaaagtaatataagaataataaatcattttatattaaattgattgagacattttttggttaaattattcacttttttgttgaataataaagagccttcaacatttttagttaacctatacagtgtttttctatagggaaaattttgatatgaaaaagatcaatgaataaaaataaaagagagataaagatatggaaaattatgataattgatttgttgatggaaaaattttacaatattttgatacaaaaatgttatatatcttttgtaatatgctcataaacaaaaaaatttcttaaatatatggaaatctaaccttcttatatattctttaaagataatctaaaaaatcgcatcgaacaaactctctcaaaaatgtactttcaaatttgtttggtttatttatcgtcataatgagtgaacgaaggaaatgggtcattcaaacagaagaagaagaagaatatgatccattcgcagatttatcaattgtagtaccgattgatattgataatatcacacaagcggtacaatgtttattgcatgatgatttaaatataagaattcaatgtgtaaacttacttgcaaaatacatgcaaatgtgtcccagatatataatgagtaaatttaatgaaaaccacataagagttcttacagaaatgataaatattgaagaatgttttccaacagccttaatgatttttcttaaaatgagtgcaaaatcagagtttccatttcctgtagatgtaattcgcttaatttcaccatatttaaaaaaagagattgaaattgaatcaaccgaaaatattcttgttctcgttggaaatttagtatcacgtgatcctatttattttcaagttggtttagatttaattccagacattttaagaattgatgttcaaaatgattcaagaattcagaaactcaagagttggacattatcacaattcatgaaatttgaaaatcctgtttatggaaacgacatattggaatttcttggcagcaacatcaacacagggaatgaaaaaactgacagaaattcactttttgggtatttcaatgcattgaattggttcacaaatttaaacgttttcatcgaacggtttatggtgatggagaacgtttacagactaatgatgtgctcagtcaattggaaaacaattgagatgtgtctttcctttcttgaaagatatttaaagaacaccacgtatggaatccctgttggagactttgcagttgcaatctcacggatttttagcttaagatttgttgataaaattcaagtctttgagcattgtatttgtgtgctaagcatatgcattctaacaagagaaaattctgtgtatgttattttccaaacatttggacaaattggaatacaaaacattttatcaacacaaatcttccaggttcaactgatgtttttcaagtttctgtgtgaggtagctcaaggctgtgtttttgcattgttgagaataccatcaaacgaatttgcggaattaatgaaacaagtgattgaatgcggtgaaacagaaatcctttggattgcattaaagacaatcaacaaaataatcaattgcatgtcaagtgagacatggacaattgaatttttaaaagtaatagatcaaccacaaggagttatagatcaaataaatggagaactcacagatgatcaaccagatgaattacttaaagagtttgatgtgtgcgtcgaagctgtttcacagatcctaaaatcatagcgcatgagataaacgttctccaaataaccgtcgcatcaaattcagaatttattcgcgatgataaaatgtattttttgtgtttttaaaacttttttaaactaaattgtattatttctcattacacataagcaaaacttaaaatctcatttcaaaaaatatgattgaacaaacaaatccgcaataaaaagacatctccttcacgagtgaagtatgttattttttgatgttgttttggtgcgtgtttagtaaacgcggtgtggtttgcccattgttgaatggagagtgatggcaccaattgattgccattgtttcttaaggagagaaacaacgtagtttgtggcaagcataacattttggtatacttgttcgggcttcattgcaacgttggcaacggcaacgccaaatgcaattgacttcttgagcctgaacttgactgtcttgcgggcttcatcaacagcatcagcaactttgtcagatgaacggattggtgctgggaatttacctgtcttgttgaatgctggacctaatgtcttgttaaggttcttgatgatggtatcagaagcaaggaaaagatgatgcttctttgcccagtacttgattgtcttcttgtccttgttgaagtttgtaagggtttggaggtcatagtatggaacattgatagcagcagcttgttcgcagtgaatcttatcacccatgataccaatgcgaaggcctggacggataacatttggaagcttgatgctaccaatgaaacgcttatcctttgcgatgttataacccttaagacggatttgaagttcgatagtttcggtgaacttcctcttcttcttgttgttagagtagtcaaggatttcagcaatagcagacctaaggttctcctgatgaatgcgagacattttgcagaaaggacggaccataaccgctttaaccgatgaaaaataaattgtgtcaatttaaaaactcacaaatatttttgccaagaacttgtttaaaaacacatttttctcataacacataacggaaatgttataatcgtctaagattagtcgcaaaaagtatgtcacaattttttaggattgatagcgaacaaaaataatatgattagatatttctggacgattcctcaatttctcttttgagcccttcgtttgtgaatgttgggtatatgatctccttccaatcaggatttgagtattttttgatccatggaataacaatcttcatccatttgtaaacgggctccacttccttggtgactgggtcaatacgcgtgtagtgaattattgcggcgtttttgagtttttctgactcgtcattgtttaccagcttttttctgaactctgattgggggatcatctctatgcgggttcgcaggacttgcatcacatggaaatgtgtaactataatcgccgaacttggttgaattggaaactcagaaagttggtcaagaatataatcaactcgaagagcaacatcagcaagtgattcaccagaaggaggtttccaataaaaagcatcgcgctcacgccacttgagttgcgcttcaaatcgcttttgacgtacggcatatgagagtcttgagagtttaccaaaatttcgctcatgaagaaaaacattacgagtccaattggcatgagggagattgagaagagctgctgtttcaagcgctcgaatgtattcactgcaaagatattgtccaaaaaaatatgatacatttttttttatccattcacctgccgctctactttgttctctacctttagatgtaaggcgccattgtgattcatgtgtttcaaggaattttggtgagaaaaattggtaatttccttttttttcttcagcataggctttgtttccttctgcatatccatgccgaacaagaatcaaatctttgggcatgttaatcaaccctacaagaggaactttttgtgattttgctaagaaacgcccaaaagaacatgattttatcatatgccgataaaagccgatagaatgggtattttcgaccgtttaaagtatatcggtaacgtcacttttggtttatgaaaaactcaatcatgacagaaaacaccacaaatgaataaaatgaaaatgtctttattttgttatataaagaacaaattataaagtaagtttaataaaatttttttttatgaatgtaaaatataaataaatctatctaaaaaatcatgtgaatatctttacgaaaaaattgaaggaatcaacaaaaaatatgatattaatgttcatgttttgtagagggatgttatgatatcttattgttaaagaatatgggaaatttgagtggtttaaatattccctaatatcactttgatatatcaaaataataaaataaatttcaaataaaacaaataaatatctttggtattaatttcaattcattcttgttcatgaagtagttgaacgatttctgtatacccattttcagatgcatacataagtactgtcaaaaataatttcgtttattattttgaaacatcaaattgttaaaataaattttgaatataaaaatatctttagcattaatatcaattccttcttgttcaagaagcaatttaactatttctgtataaccatttaaactttttaatttgtgttttctattgtgagagataatttcaaaatgtttgttgattttaagaacgttcaaatcaaattttatttaacaaacaatactattttatgggatttcataatatatataggttatttattttattacattttattcatttaatcaacttcttcaacgcgtgaatgataactaattacataatttgtgttattttatttgttttctaatttcttttgcttagctttcaaatgacaattgttgaaccttcaactaacactgtgtatctgttgcatctgatctagatcgtttagatctcttaaaacttgtacaatccataaatcttaaaaaaaaaaaaaaaaaaatcgataaatcattaattttgcaaaattaatttatttggatttttatccatttttgattttttacacgaccgttaacaagaagttataacggttttgttgggcctttgatcaagcaatgtcaccaggagttggtatgaagaccggaggacgcggctcatggcgtcgtaagacaaagaaaacacaaaagaatggaaaccaaaatggacttaaagtttggttagcagcacaacgtcttggatgccgtgaatttggagaattagattcagcatcaataattcttcaaggcagcgaagaagcactttccttccaaaaaccagaacttgcattcaacatgcatgcaaatacatatgctataatgggaaaggttgaaaagaaaccaattgttgaagtattaactgatctcatttcaggaatgaatctttctggacttaataagaaagcagaagaagaaaataatgatcttggagatgttccagaagatgttgatttctctaaaacagaagaagagccaaagcctgattctgagtaaacatttatttacatcaaaaacagactttaaacaaacaatacaccaatcgaaacatttgacattattaaccgttaaaatattgaaattttttatggttttcaaatttggtacacccacagaatttgtgtgaaaaatgatcgtttagatgtcatcagaaatcggagtacctttattccaatggatccaaagtttaagagctgatatcttgcaaatacttaagctctacaagtctgtcgttatacatagaactaaacttgcttgcgtttgttcagaattacatgcattcgtcaaaaagttagcagtcatgaaatgcggcaataaaattgcttctcctactgaaagcatagctcttcgtcaagcatcccagttaatatctgatcttcatgaactatttaccaatttatttgaagaaaattacattagaatattacttgaacatccattactatacattaatgataagctcaacgagttcaagaacgattttaacaaagctattgaagattcaaaaattattgaatcaaatgtctttcgactttcaaaagaacaagaaaatgtagatgaccaagtagattgttatgatttacgcgataaagttgaaacaatcatttcaaatgatcaatcaatttctcaagaagaatcacaaaaacttcaagacaaactagaagaaattaaccaacgcatcagtgtacttgacgacaccaaagattcacgtgttcttactgctgaggaggtagcacaaggtttttcacaattcagtgaatttgcatatgatcattccgcttttgagttacgaaaacgcattggctctggtggttttgcagatgtgtatcttggttatcacatcaaagagaaacgttttgttgccatcaagaagatgaatgcatcacaattcgacaagcacacatttgaaatgcttcaacgtgagattaaaattgcgtccacacttaaccactttgccattttaccatttattggcataactcttgagcctccatattacatcatcaccgaatacatgtcggggaactcactctttaaacggcttcactctgattcaaatccactttcaccgaccaaacatactattatagcattaggtgttgcatgtgggctttcctttatccacaaaaaaggattagttcatcgtgatattaagtcacctaatatcttattggatgctgatgattatccaaaaatttgtgattttggtttgagtcgaatgattagtaatgattctgaagtaatgacaggtggtacaggtacagcacaatggatggcgcctgaagtccttgattccaaaccttatggtaagaaagccgatgtatattcatatggaattctattctgggaattactttcgcatgaaatcccttacagaggtctccgggattatcaagttgttgttgcagtgatgcaaggctcgcgaccattaattccgacgacctgccccaggcgaattgcgcagtttattgaaaagtgctgggacaaaaatccagaaaaccgccctgactttgacattattgttaaagcatttgaaagtgggcaattagattttccaggcacgaatcatagtgaagttgaagcatatttgaatcaatttattaagcggaaagaaacagtctttaatccaggtgcaccatcatcaataacattatatcgaattttagatgatttaactaataatatctctaatttgaagacgattatagatgatgagaaatggctagaattattttctaatgaaaaatgcattaaaatgtttattgattcaatgaacaaatgtaatacattacaacttgcatttgatttctcactaattattaataccattttaaagaataatagtttgtccacgatatttatcgagaataatggaactaattcatatttaaacttattcttaaagtatggagtttcatcaatgccattagcgatttctaatttattaatgttaccattaactaaacttaacaaagaacatttcattaaacttgctccatttttaattacatcagatttatcgaatcgaattaattgttccatttatataatcaaattattacaaggtaaatattatgaaaatgattcagcaatatgtcaaatagtacaaaatgttttagtgaacgttgtaccagaatcgccaatcgaattacttaagttatcactcgagttgttgaagtatttaatcgaaatacctaaggcttgtcgaatgatggaagcttatgatttcacatctaaaatatgcgcattgttattatgtgatgacgattatattgtttcatgttcacttgagttatatactaaaatcgttacgacgacaatacttattcaaaagagtataattactttcgttgatatgttcccaaatttaattaataaattcaatgatcaaaatcaacgaaaattaatttatatattagcaaaaatgatatttaaatctcctagtgctattaataaattcattaattcaaacgaagcgtgtgaagctttagaaaaatgtttggagagcgatgattcaaatgttgttatgttatcattaaaaacaattgctggcttactgataaaaagtggctgctattcaacatttgaaaaagtttatccaaaattgaacaaattctttgcttctgaatatgattcaatgaaaggtatcgttgcttcaatttacacgttaatccttcagaaatatgacattgaaaagttcaaaacatttgaactgaaaaagttcatcttagaaaatttgaacgaaggtgaattgaccacacaagctttgaatttatgtggtgtaatctcttcaactttaaacggtgtgttgttcattcaagaagcaataccttctatcgtacggttattgaaaactaaagaatacgctaaaaccgctctgatggttttggcgtttgtatcggtcgttgaaccgatgtcaaaaccgttgtcagaatgtgtttctacggttttcggttttttgggtgaccccgaaatgacacaatatgctttgattctaattgctaatattactataaatccttatgctgcaatagaatgcgcaaagaacttggagggtctggtgaatatgattaagagtgatgatgaaatgaacgtgaaaagaactttcattgcattagaaagaacgtttggagtaaatgaaatcgaaagttacgttgacgaacaaggcatcgaaaagttaattggttgcgttgatgaatatttgaaaactgatcaggcatctcagatcttgctaattttggacgcaatttctagtatgaagattggaaaggaagtcatcattaactcatcccttccgaagttcttgcagagccaattggagcaatcagccgtaaaaggattagctcgatcatattatcaaaggattcttttgcggactttaaattccactgaataaatttccatatttttaaatatcgatttcaaaatctctttaattcaattgttcattgattattatcatttgtttgcaatttttgttattaattttattttatcggaatttattttatttatttattacgccttttatgtgcgcgtgcgctttcggtagtttagaagctgttaacgaatatttgaaactgcttttactcaagcaataaagaatgatcgtgtagaagttgttaaatttttataaagtggttgcagaaagttctctcccaaacacttcagtttttgaatataaatccgatgatttttcattcattcggttctatcgttgggaaaccttataatctaaaagaaatagaaagccgaatttgatgaaaatgataaacggtcgatgattaacgtattttcaaatgttttctttggcgattttgactcttttggcttttgatttctcaaaagattcatatgaggaaagaaggaaaacaggtaacgaatgtaatgttgtggctgatggatgttcattctctcaaacatatcaagatcaggttttatttcctttgatgtttggttcttcatgttcaataacattagaaacatgtaaagttggaagatgttatggaattattgattggacttataatttaaaatgggcatatgttgataacattcaacaatctatttttgcaaatttttcaattacaaatgcaaggtccgttaggatattgccaacaggagttttatttacgccagcatcttctattgtacatattaatttcactgttcattcatgtgaagatttttacagaatgcatccatatgaacctattgaagaatgcgacagagcaattgctaacataagttcaccaatcagaggttcacagttttgttaatttgtttgtaaataataaattcataaattcttttcaaattatgttttagccaaaactgaaatgtttattgaaccttttcacatgcacctcctgcagctttgatctttctttcagcagattgtgagaaatctttggcacgaacaattaatggaatttgtgggagttcaccacgaccaacaactttgaaatatccattggcaacgcaatcaatgactggaactgcatcgccttgttttttagaagcagcttggttgcgaacttcttcaggaactaatgtccaaagtttgtcaatattgatgattggttcccattcgcggcacttgaatacatgaagacggcgcataccaaccttaccgaagtatcctgggtgataacgatcgaaccaagttctttgatgatgttgaccaccagcattaccgcaacctcctggtgacttcctgtgctttccaacacgaccgtaacccattgattcttggccacgaagcttccttgacttcttgaaacgagttggcatcccgaaaaaggacggccaaaccgccgataacctccgaagccattataataaaattaattttatgaatgataatcaagtttttcacgatgttaatgcaaatttctctaaaaaatcaaaaaagaactcaaaagattctggtgtatatttaacattacttacttcacttcaaaaaatcatatttaatttaactgatgaaaattttgatttagctattgaacaaacaataaaattatttgataagaaatttccatattcatttaatgttactataagtaatttgatatatttatcattttattcacataagaattcatatttaagtgatttatatatcaaatatttagaaaaaattcaaacaaaagaagaaatagaacaaagttatctaaaagttattacaatttttattgattatatatgtggaattaaatcacaagaatcatattatttaattgagaaaatgattgaacaaaaaataattgaaacaaatattatcaaaaatataaaaacaaattatttcatccatcatagatcaaaaaagtatccacatatttattccaaaaatgatccaatatatatttttcttatgaaaaactataaagaactttcaaagaatgattgggaaattcataaacaattaattcaagaaggacaaaatccaaatgaaattgcgaaaataattcgaaatgatgaaatagaaaaacttcaagaaatatcatcacaaaatgatttttattttaaccaaagaattaaaccatcactttatgaaaggtgttcatttattaatcaagaaaatgttacattaattgattatgcagcatttttttctgctgttaaatgctttaaatatttacttatgaatgattctaaaatagataacacaggtaaatatgcaattgcaggtggaaatttagaaattattcatttatgtgaacaaaatcatatctcttttcaaaatgcatatgaaacagcaattatatttcatcaaaatgatatctttaaatatctttatgaaaataaaatagaagaatacgctcaacaaaaagaaaatgatttaaaatttctttgcattaaatatggaaactatgaacttctatcatttttagaagacatttccagtaaaggatttaatgattctatcttcaaagagtcagcaagaactggtaacttgtatcttgttaaacattttctaccaagaaatatcattacagtggatcttttatgtaaatcttcggaatcaaaaaattttgaacttgttcagtatattcttaaacagaaaagaagtaatattaatgctaaagacttaaatttattttgttttattttcgttttaataattttatgtttcataataatattaggaaaatatttaaatcattttcaacagcacttatgtatgcaactcaaaatggtaatacaagaacagttaaattacttcttgaacaaaagggaattaatattaatgacagaaataatatttgatttgttaaaaggaaatttggaaataatttttggaaattttttcaaatatttaaaacagcacttatattggcatctgaaaaacgatatacagaaatagttgaattacttattgagaaagagggaaaagatgttacaattaatgatagttatttgttatgattaatgcttccctgttaaatttaatattgttaaatttgttttgggaattattaaaattatttgaaaatgcactaatgaaagcatcgcgttatggttatattgatataattcaattactttttaaacaaggggaaattgatatcaattcaaaggatttttatatgttatatttaaaatttaatttattttattgttgtttgataataaaatttaaaaattcttccatttttttagaacagcgctttttcatgcatcttcaaaatatcagacaaaagtagtcaaattacttcttgaacaagaaggaattgatattaatgctaaagatatttatttgttttatttaatatttattttaataattttatatttcaaaataataattggaaattatttaaattatttctaacagtattaatattagcatctaaaaaaagttatattgaaatagttaaattacttattgaacaagaaggaattgatattaatgctaaagatatttgcttgttttatttaatatttattttaataattttctatttcaagataatatttggaaattatttaaattattttatacagcacttatttgggcatcttattacggtaatacagaaatagttaaattacttcttgaacaagaaggaattgatattaatgctaaagatatttatttgttttatttaatatttattttaataattttatatttcaaaatgatatttggtaattatttaaattatttaaaacatcacttattttagcatctgaaaatggtcgtacagaaatcgttaaattacttcttgaacaagaaggaattgatattaatgctaaagatatttatttgttttatatgaaatttattttaataatttaatatttcaaaataatatttggaaatcatttaaattattttggacagcacttatgtgggcatcttataatggtcatacagaaatagttaaattacttcttgaacaagaaggaattgatattaatgctaaagatatttatttgttttatttaatatttattttaataattttatatttcaaaataatatttggaaattatttaaattatttaatacagcacttatgtgggcatctaaatatggtcatacagaaatagttaaattacttcttgaaaaagagaatattgatattaatgctaaagatatttatttgttttatttaaaatttatatttcaaaataatatttggaaattatttaaataatttaatacagcacttatttatgcatctgatgaaggttatacagaaatagttaaattacttcttgaacaagaaggaattgatattaatgctaaagataaaatttatttgttttatttaaaatttattttaataattttatatttcaaaataatatttgaaaattattgaaattatttgatacagcacttatgtgggcatcttataaaggtcatacagaaatcgttcaattactttttgaacaagaaggaattgatattaatgctaaaaatgaaatttattttaataattttatatttcaaaataatatttggaaattatttaaattatttagaacagcacttattttggcatcttcagaaggtcatacagaaatagttaaattacttcttgaacaagaaggaattgatattaatgctaaagatatttatttgttttatttagaatttatatttcaaaataatatttaaaaatcatttaaattatttaatacagcacttatgcatgcatcttcaagaggtcatacagaaatagttaaattactcttagaaaagtaaaacatttatccattatgtaaagctttttatttctttcccatgaaaatcagatttggaacaattaattggtttgttaaaataaacaaagaataaaatgattattaatagaaaggaattttaaaaaatatttgagacttttgcctaatttgttatattttaaattcttcataattgtttccaaggaaaaaatcgtgtgagcttgatggatatggttctgtgccatactatgcccatcattcgatcggtaatagtattcaaaaagtcgaaatttgattggttaattttgtgtctttttatgaaattcttttagcattgttttcttcgctctctaaaacacaggtatatttttgaatttctgaaattcgtagaggagaaaagaccttcagattatagagtcccctgggagaccgttataagaagatatatctgaaaaaattttatactgacttgatattgatccatatatttcaattcaaagattagcacacctctttggccatcatctatttactatcaaaactcatttaattgaacatttagggtacaaaaaatattatagacggtggttcccccgcatgccgacaagtgatatgaaaaagaaaagggttttcacttttaaaattccaaaaagaaggatatcgccacattataacatgtaatgagttttggttttatttaaggtcctttcataaatttatttatgcacaatctcgagaaaaagttgaaaatattccgaaaaggttaatttaggaaccaagtaaacaccaaagatccttttatataattttgtgtttcgctattaaacctttttttaattctatagcaaaactttctcaaaaagttaatttggcactcttttgcacttacatgcacttgaacaaaaggtttccaaatcattcatgaggtaacaatttatttacttaatgtatttaacaagctaaataattctgaagtttacaaataccacttttagttatcttcacttttcaaaagggtggtaacggtcttcagaaacaaagcgccatttaagaaaacctttgcttaaaatgctttttttaacattattaatttattcaaagagctattgcacaccattatataaacaagcagaaacaccgccagggtataatgtaagacatgtttcaattatttttaaacatgggatgcgtgcacctattgacaaaattccaggacatgacataccttggaattgcaccggagaagaatggctttacccaggaggaaattcgttaaacgatgaacataagtttaaaaatcaatttattattaaaactattccacatcagagttttctccgcggaacttgtcgtgcaggtgaattacttaaccaagggattgagcaaatgaataatttaggtgattatttacaatcaaattacaaatctttattatcaactcttgattctaggcgatctttttcatttcgatccacttacaccaacagatgtcttgcatctattcaaaccgttgctcaaaagctattaccaggagaagatccagttgatgttttcgttgcaaacgaagagcttgaatcactcgtgccaaatagttatttatgtcccaagcttggttcattatatcgcgatgttcaaacacctaattccaccttttccaaaaaaatgaagattttcaataatcacctcaatcatatcaaaaacattagcaatatcacagtcgttccacattggtcaagaattggggagcttctcatcactcgtcattgtgctaatcaacatcttccagggaaattcaccaatgaatttatggccgaatctgcaaatcttttagtagatttctatatgggtgttatgaaccttacaaagggtagatccttttcgtccggattattattatctgacatatatttggacatgcgcgattatctttcaggtgcaaagaaatcgcaatttacgctcatatgtggccatacattaacaatagtttcgcttttagcttctctaaatgagacagtaacatttcctgaatttgggaaatttgttgcgtttgaagtcttagaaaaaaacgaaaatccaaattctcatttagtaagaattttattaaatggtgaagtattaaaaacaatggaatttaaagaattcgaaaaaatggtacttcaaatgaggcctaaagaagaagaatgcggaattcggtacccgttcttagaaaaagataaaggggatcctggaattaagttactccattacgccttctcttgagttaagatattttgtttgtaaaaaaatattttgatgtaaattggattactttttgattgtgaatgagcggttttgcattcaaacggttttatcgtttcttaagcttcttagtaaagaacataaaatatctttttcgttaacaatcattccaattttgtatctaaatccacacgaaacgtattgtggtcactttgtttttctattgaagaaaatattttttgactattgtattgtatttacttattcacttttataaccacattttaacattgtttttagaatgagatattatgaggaattggatttgtgccttaatatttttactgtaatgctctttcttgcgtgttgttcgcacattttatggcggtttcattcaatttttcaagtaatgtccgaagaagtagaagaattaaagcagttagctgaaatacaagcaaacctttatacagttgaacaacttttaaattctcaacaagctaaacatgatcagttaacagaagaaacactttcttattcgaatgatttaattagtgaattaagacttctgagtttaatccgatatcgctttctttgcgataaaacaggctatgaaaaagggatattaagatcccaagagcttcatgaaaaactttcattttctgctctagagtattgtccatctttttttgactcaaatgttttaaatcactatattacatttatttcatttcttcggtcacatcttgatatacttgcggaatgtctttattcttattctcaaaaatatccacaaaaaatcactcgcatttcgtccttatttcttagtattttccaacaaggctggtgtaaagaagaagatcatcttttatttcttacacttagacaattagccatattacaatttgaacgaaagtcacaaatccaatttaatgtcaaagaaaatgttcttaatcctccacggttttcaccttccaaaattctttccatgcttgaaccactttcatcttttgttacttcatatttgtttaatggagcatcattttcatatcttcaatgtgctcttagtcatgttgttactattcttcattcgttatcacgcctacgaaatcttcgtaatcaattttcgaccaattctgaaagcaacacttatgctgccatggaatattggacggttatttgcgacaatgcacttttatgttttgactcgcttattcgctgtatggatttgcttcctcctggggtaccccaactttttcggtttatccgacaatttgagaatggcaatgaaaaatgcatgttattattttttgaatcatttgtctgtcgtgcccttgacaatccacaattattaggattgttaccatggcatccaggcaatgtagaatggtcaccaacgcgagatataacagcagtctttcgatctaagtatgggaaatattcgatttcatcatatcgaaattgtttagacatctttcaaaacccacttacgcatgtattatcattaatacctgcgtatgaaaagattaatttcgacatatttttagacgcgttaacaaacactaagaaacgtcatgatcaattaatatcagaatgtgaacttttatatacgaatccgaactttccaaaagagttagtaattactgctcgagatctttgtgtattacatttagcagcgctttcaatccctaagaacaaagtcaacaacaaaaacttcgaaaagattttagatctcttaaataacattccagagaagaacgaatatattaatgaacattttaaaattgtattgttacgacaaaaagaagtaacaattgcagctaaatcagtccgaactaaatcacttttctcatttgatgaagaagttagcacaacgaatttacttaactttccattcgagaattacttctgtgacatcattgctaatttcccatcatttgcagtaagtatatcatcatttaagccgaagaatgcgaaagagttctttgagaagatgcgaattgttgctccgtattttgtctccgagaaattattaacacaatcggatgcattattttattatgcgattaataacactaaatcaatctcatcattatttcctaagatatatgaaatcattaatcaacgtaattcatatgcaatgaattccgctgataaaacgtcggcattacgaatacattatcaacgtattacatcatcattatccgctgtgaagaaaatgcgtgagaatgtacaaggttatatgttatcgaatgttgcacgatatttaatacgtaatgacttaaactattgcttcaaaatcgtaatgtcgaaaagtattaacttcttatcaaacactgaaatccttaagcaatcatttttggacttaaaagaaatcgcatcgaatgtattagagccttataaactattaccacaacaatgttcattaatatatcgaatattgttttttttgatgactgatcacgtatcatttcgtagattcgtattaagtgatcaaagcgtttggaagaagtcagtgatcatctcaacaataatcgaaaacaatcacgacgaaattattaatgaaatactttcgaattgtaaagaacaattcgtattaagagaaaagtacttgcaaagagcaagtgacttactcggacacattcagcccaactctggtatagctgtcattctttattacgtagtggaatcgattgacattttgactgagttggaattatattgtgaaaatatccaaattaataacttcatactgtgggttttggtgtctgcgagagtaaaacatatttatggaatcgcaaagttcatagaacacttcttcttgaagagctcgttcttggaaactttgctctcgaacgctgagatgaaatacttgggaatattctgctcgtcggtttcgatgattttgggaatttgtggaaaatatgacaaaagaattagatcgtggaaatgataatttgtggtttggaattttataaagaaataaaagaaattgtttaataaattcgttcgtttttggcgtcgatgtaaaaccttttttccgtacggtagaatgttaaacaaaaatatattggaaaatgttcattattatggagttatggataaaataatttataaattcatttctatcaaaattgtagaagattaacattttgaattttttgtaaaaaatacaaatgaataatttaatccttctattcgataatataattctttaaaaaaattcaggaattgtatgaattatagaagatatttaataaattttgcatccgatattcttaaagcaaaaattgactacataattgttttttgcttattaatattctttgatgttttatgattttcatatgtttttgactaagtgtgttagatattggagagaattaacgttcgctttttttttctaatcgaaaaatcttacctaaaaatcattttaatgactcaagatgtctcgttctgatgaatgataactacccgttgtagcaaaatcaaacaaaatatttttgatgatatagagaaaaaatgtaatcttaaaaataattgaatcaaaaaaattttaaaattaaaatatctcaaaatcatcaggataatttccaaaaatacttgagtcttccggaaagaaaactagaatataatattttattttattagttagctaaaggtcaaaatgtcaaaaccgctttatacctttgttgcagtaaaattcgaacaaagttagtcaattcacaaaccttttttatgtttccataattttctattcaattatcaccaaactaaaacaagaatatcttccaaaacaaaatagatctcacgaaataggtagaactcgaaaaatctcatttttttattttttatcatatatcgacatcatacaaaaaatcataattttggagctgttatgaactgtgcattgactaaacgatcagaaacgatagactacgatcttccatgtcacacccaaacagaacaacaattttgaagtactttatcaaacctcatcattttgttttaagagcttcaaaaacccaagactttattcttctcatttttataagtaaaatagttttcacctttgtttttaataaacatttacaattccagcaacaaaatcaaattgaaaaccaatgtaattttgcgtctactaatacaagttctttatcaccatttaatcatctttttaacaacaaaaatttcaacacatttgatgatcaacaacctgctaacattttggtaaaatcaaaaaaaacatgttaccaaacataccttattgatcttatgcgatcaaaaaacatattattatcaacgcaaacaaaaaaagaaattttcattttttgggcaaaaattcataaattcattaaatttttttcattaaatgaaagcaatttttcattttttagaaatgataacatttatatagtttcatttattgtgtttttgattaaatttcacttatcgaaaacttttttgcgacataaaaacattaatttgtttttagtgttttttgttttactgttcgcaaatggtttctcaacttttgataactcaactaaaacacttactatttcaaattcaacagattatgataatagaatgttatataaaaatgaaacaattcatgttattattggaggttccatcactggaattggagataattgtttttatgagtggaataatttggaaagtatcaaaatgaatgaatcaatcactttaattggaaattctgcattttcatcatgttctaatttgagaatagttttaattggagaaaatgtaacaacaattggaatttctgtattttcatattgcacatcattagtaaatattacaattccaaacaaagtaacagaaattggaaattatgtattttcatcatgttctaatttgagaatagtttttattggagaaaatgtggaaagaattggaacttatttattttcatattgcacatcattaataaatattacaattccaaacaaagtaataacaattggagattatgtattttcatcatgttctaatttgataatagtttttattggagaaaatgtggaaagaattggaacttctgcattttcatattgcacatcattaataaatattacaattcccaataaagtaacagaaattggaaattatgtattttcatcatgttctaatttgagaatagtttttattggagaaaatgtggaaagaattggaacttatgcattttcatattgcacatcattagtaaatattacaattcccaataaagtaacaggaattggaatttcttcatttgaattttgtaccaaccttcaaatgattaaagtttccagcgaaaatgcaaattattgcaattataacgaagatgggattttatataacaaaaacgtcactaaaatcccaccgacgcaatcgttcacacgatcgaacacatactcaaacacatttactcagtcgaatacgttcactaagtcgaatacattcactaagacgaatacatttactcagtcgaatacattattaccttcgaatgtaacgctgacactttcgtttacgaattcatattccatcactgaaactgttacaatttctggtacatattcttattcatatgttttgactttaattggagttagtagtacatatgtcagaacagatttaatttattatgaatatattgtgactcgttattcgacgttatatagtttttattcgaatttcttcacaattatcgacgtcataaatcctgttggaaatggtatttctcaaaaggctttgataggtattatctgcggcacaataattgcagttttgctgattatgggaattatcatattccttgtgaagaaatcaaagaaaagtaacagcgaatcaacagcgataaaattcgaaactaaaaattcaactggaagcgatatgagatcagatgaagtaaatcaggaatataatgaactcgtgttggaagaccaggaccaatggctataaaaatgatatgtgaataatttctttaaatagaaagtactttgataaatgttaaacattaataaatgaattcatgaaataattttcgtttttatataatttgtatgtttataattaacatttaacttctttattatgcgtatgttattgaaaaatattgacatacttgcaatgatgttgtaaatgtatttgattttatgaatatgttggacagagtaaatgtattcgtgtgtgaatgcatttgatctgaaaaaaatatttgaattagaaaataaatttgattgtgtgaaagtttgtgttgaccaagtaatatatccttcaacagttgtttcttttgtaacattaaaaggaccaaatgttatatcgttataatagtataatgacataacatttattgattcaatacatgtaaaagctggtgatgaaatgtttggttctgatttaccatgataataaatacatctaagctgtccacagatatcaaatgtatcatcgttaatgcttttgacattttctacaataataattgtactaaatctgtacatgatcgaaattgtttaattaagtacaatctttaacttcatgaattgcaaattaatgttttaagatccaaaaatctgagaaatgaatattatgttaagaagtttatcatatatccgctctctttatcgattcttcggccagaaaatcaaaagaatttctaacacatttacacaatttcatttcgaaataaaaaataatttaaaaaaaaaagtttgtattaaaaaaacatatccaatataaaaattggtttttatatctttaggaatattttcctaatagtcattttttaccaatacattaattaattggtttttcatattaatttatttattttaaagcaaagactcaagtgcactgataactttgtcagagtttggtcttttgcttgattccttatcagtcattttgctgataagtgattttggtttttcggcagcatttatgttcgcttcgccgttgtcctgaagttgttttatagtttttattttcgacatttgagtattaaatgaaccaaaaacttcggggaaaatgattccaaggctataaatatcaaatttaggaagtttgatcataactccaattgaatatataatgatatgttgtccttttgtggattgtgctcaaatcatatgtcaaaacatttgataacattggggtgcgaaatttgtgataatatctagatttcattaaaaacattatcaaaagaaatatttttaatgggttttatccataacttttcccagaagaattgctaatatctggggaatcagttccattcattccttttccaatttcgctttgaattgtaaactatgttcaaaatcgtgaagttaaactcaaattcgaattgtatttctgtaatagatgcattttgtcttttgcacttgatgttgggtctgctaaatttcccgtagacatcaaaaaaaatataagtcgatgcaaccaatggcagaaattcaatctttgctaaacggtcgtgcgcaaagtggatcataaccgttttattgtataaaagtgacatatttatcaaaaagtgagtattaaaatgtttacttatgtaaactaaacgaattctatcaattccttagttttttaggatgggttcagtcgttgttttgtattcaaatattccgcaattaaaacaaaaatatcttctaaaccaatgcacgttctgaatagcaaagcagcaagcaaaggcaaaattttttattcattattatatttcgatatataaaaaaaatttacatatttggaacctgcaaattgtcaatttcagttactgtaaccaagaaacctgaaactgacgaccgcaactctttatgtcatttcaaaccagaacgaacattttgaaacacacgaataaaacatcatatcttgctacaaggacatcgctttcccataccttcttctatgttatcactctaagtaaaactattttcaatattatttgtaattatcatttaaattttcaatatcaactacaccaaatcaaaaaagggcagatcctatcgcctcttaggaacatgcttttgtcatttaatcatacttcctccaaaaaattcaacagtttgatttatgattatcatcaatctttaaattttcataacaaattatatttccctttaatttttttaacaaattgttctttttatttcaaccaagcatatgcccattcattaccttttcattctcatttatcaaatcataaaattttcaaatctcaaatatttgattttatttttaatattattttaaaagaaaacaatttttgtatctttaaaatcaatgtcatttatttgattttatcttttatctttttgcttttatataatttttgttcaattacatcttttttactatataaattccataaaatacatcgaaatgaaaatttttgtttgatttttctttttacatttttcacaaaatgtttctcaacttttgataattcaactaaaacacttactatttcaaattcaacagattatgataatagaatgttatataaaaatgaaacaattcatgttattattggaggttccatcactggaattggagataattgtttttatgagtggaataatttggaaagtatcaaaaatgaatgaatcaatcactttaattggaaattctgcattttcatcatgttctaatttgagaatagtttttattggagaaaatgtaacaacaattggaatttctgtattttcatattgcacatcattagtaaatattacaattccaaacaaagtaacagacattagaatttatgcattttattcatgttctaatttgataatagtttttattggagaaaatgtaacaacaattggaacttctgtattttcatattgcacatcattagtaaatattacaattccaaacaaagtaacagaaattggaaattatgtattttcatcatgttctaatttgagaatagtttttattggagaaaatgtggaaagaattggaacttatgcattttcatattgcacatcattagtaaatattacaattcccaataaagtaacaggaattggaatttcttcatttgaattttgtaccaaccttcaaatgattaaagtttccagcgaaaacgcaaattattgcaattataacgaagatgggattttatataacaaaaacgtcactaaaattatatgttatccatgcgggaaaacaaacgaaacatatacattcccaacaaatgtcagtgtaattgatattaatgcattctgtaattgtatttcattaaggaacattgaaattccatgcaatataacgtcagttggaagcaaagcatttgcatcatgctgcaatctcacatgtattttttattatggcgaaacagtcccaacgaatacatcgaatgtatttgataacaacaatttaatcagaagtgtcatgacaatcgattcatataacggccaaacattctgcggtataaaagtcagtaaaggaaaagtcattgatgaatgtctcccaccgacgcaatcgttcacacgatcgaacacatactcaaacacatttactcagtcgaatacgttcactaagtcgaatacattcactaagacgaatacactaacaaagtcatatgaaatttcatttgttgtttcgaattcatttactttttcatattcgaatggtataacattaacgaatacaataacattaacacaatcattatctattacgcaaacaataaaaatttataattcgacgtattcgaattcattttctgtttctatttttaattcggcattaacttatgttttgagtgaatttatttattacgaatatactgttgttgtatattcgacttattacatatattatagtaatttctttacaattatatatcaaaatgaaaatattaatgatgataatagaaacacaattataattataagtgtttgcgttgcagttgtcgtaattgtaataattgcaatacttatcatagttttgatgcgaattcataataagaaacaaataagtaatgaacaagaagcaaaaagtttcgaagaaaatcaaaatgaaaaagaaaatacatttgcaatgggaacatcaacgaataatattgatgaagatccatttgctgatgatttcaaaaaagaaaaattcattaatcatatttaacataaaaacatttgcttatttaagtaaaaaaaaatcggtgaaacttaaatttataatttgaataatatttttatcatgagatatgttgtgtttttaattagctgcataatatcactgctaacctgttaaatatgggcactaatatatcaaaatcagaacttcagcaaaatataaattttcaagaaatttttgatgcaattgcataacactgaacacatgttcgatatggatataatttttattttgtattctattcatttatcaaaacagaacttcaacaaaatttaaatttaaaatttacttaaacgaattttcactttgaataatttctttattaaaatcattgattcagtttcccttcgaggtaattccttacccaatttgcgggtgttttctcgtttggcttccccttctcgttgagcagtcctgcctttatcatcctcttcttctcctgtgcgactgggcccttgccccaacacttcggatatgtgcctctgtccatgatgactcgcttaatctttgcagcgaacccatggtcactattgtacatttgctctgtcgtcattaacgcaatccccaatgcgattgcttctcctttcgtcgttatgatcacaacaacttcgtcaacttcgattccgttctcaaatcgaagtataccaggaatcataactttagcgccgtgacacactgcgtcgactgatgagtccttcattacaattcgtttgtattgagttaacatccattctaatggcttgacgactcggcgaagatacgattcgtcgcctttggtgtctaagagccatttggcatctaagacatcgtacattgtgttcatgccggtgttctctgtgatgtgccctgtgcgcgtacgtcgtagctctgccatttcaccaccaactcctaagatcaaccctaaatgttcacataaaactcgaatgtatgtgcctgcttcacacgatactttgagaatggctaaattattctcttggtcaaattctataacttcatctttgtatatatttcgaacacgaagttctttcttgacagctgatattaatggtggacattgatatacacggcctgtaaggaatttaacagcattctcaagatcaggtaaagtgacatgatcaaataacttgagaacagcaacatactctttaccggcattttgttgggctttggcaatacgtgtggcacgctctaaacagataataagaacacctgtgactttgggatctagtgtgcctgaatgtccggtcttttcaacttgtaatatttgtttgacccaggaaacaatttcatgggatgatggattggatggcttgtcaagattgagaacaccatatttaagatgttcacgaattggtcgttttaatggtgaatggccacttccaattggtgtgaaaaaattggttttacattgaagattggaatagtttttaagaagcaatggccatttggatgtgtcaggagttgctggctgttcgtttgatggctgaataacgtctgtcatttgagctctggtcttggaattcaaacagagtcctgtcaattctcactgttggaccatatggggatactgcttacaaaatgaacaataaaaattgttttatttgttgaatgaactccatatgttacaaggcaacctttgtttttattaaaaaattgcgatttaaattcatcgaatttatatcaaaaataaaatcaattttaattgttacaacttcttacaaaagaaaatgcaagttgaatcgaatcttagtaacttcctagagttaaacaacatacttgttaaaaaaaatcctttaacactaaaaaaatcaaaaaatggtaccagtggggttcgaacccacgcacctctcggtaatgggacttgaatccatcgccttagaccactcggccatagtacctctggttttttaatgaaatgttttatagaaagtcaatacattcatccccatctgtctatttgcattaaagatttaaattttaattattgtattgattttcagaaaaaatattaaaaacccattaaagaaagatttaattataaataaagaaaaaatgtaaaaatatctataatttccgtaaaatgtatatatagtagtagccacttccagatggcttaagcactttttctgtttgaactaaggttattagattttcttgtgtcttgaaaagagcttctcgaaattgtggctctccatgtgaaatagaaaagaaaacacctgaaggctttaagattcgtgaaatttctgcaattgcatgtttagctttttttgtgttgaatttggaacagagtaatgaatcaattgttcctttttcaaagattgcatcaaatgaatttgaagggaaattggtttttaaaatatttccaactatccacactaagttgttgttgccttggtaagtttccttcatttgtttaattacattttgtgaaatatctattccataaactttctgaaaaaaatctttttgcaaatctgctgctaaagatgaattaccacaaccaacatcaagtgctgctcctcctttacgaaggaattttgcaatactatctttgaattgctcccaatcgagataccattcaaactcttcatcattgtttgctaaatacttttcttcccaatatgtctgttcgtcatatttaatagctgtgtaaggtattatattatcaagttgagcttcgagtgcttcataagccaacgaagcttcgttcattgaccaaataaaaatagaaaagaaacacccccataaagcgaaatagttctttcgagtaataaaaatatggtaacaaaaatacaccacaaccaatgtgtaacaatgtgacgaaacatgacaatgcaaatgtttcatatgaatcatcgaaaaataaattgcttaataacatataccgtgccaaagtaaaagaaacagaaagttcaattaacaagtagttttaaataatatggagtctaagagatgttaacttttttcttataaaagttttcttccaaataataaacgtacaccatgagttggagttacctcttggaaacagatactctcacacgagaacaattacgcaaatacaatgtcagcgagctgcaagaaattttaacacagttaggtttggattctacaggaaaaaaacatgagcttgttgatagattataccaattctggttcgaaattcaatcaccgtcttctacacaccgtacatctgcaaatggaaaaatcatggcatcgtgttgcattaaattccaacttcctcaaatagatgacattctactctttagatcaaaattagagtcttatggacaaataaacggattattacttgatccagaattaaattcttgttatgtctcttataagactttgaaagccgctcaaactttttttgatgaatgtcaaaaaaacgaatttcaaaaccaagaatttgttacagaagccgacttcgaaaaccgcacaaaagaactccaaatgcttccaaaagaatgtcaacttcacaactatataaataatagattcaaaaaaactaacacaaaaccaaggattttttggtgtccaggaccaaactgtgaagaaatatgaattacagtgcgttgatttgttatttatttaaacatacatattttgaaattatactttcggtgttaacgctaattgtccaataacttttttaggttaatggtccttgaaacgatctatggttgttttgtgaaacagtgaaatgcttcgtaaatattttacttcaaaatcaacacagaaaatttcgacggtttccactgttggcttaaaccgaccactttaaatttttaaacgttcaccttaaacgatccagatatttttttctttttaactttcccaataaatatttaagagaaacatattttatagcaaataaaatattctatattataataacaaaatgataacccaaaaaatatctctatacatttagtaattagtgtataattccagttttaaaaacgatgtcaaaacaacgtggaacgaatttgtttgcgttcaattttcagaatcattttcagttaactgaaattattcaaatattgagagcatcggttgaggaaaaaacaacaactgttgacatcacaaaatgttacacttgcttgtttctcttgccttctcggcatactaccaagcacacgaagaaaaatccttcgtttcatggatgcgttccacaaaccaattcttcactggcgatgaatatcaaacacgtttcggtgtctggatggctaaccaacgtcttgtccaagaacacaaccaagcccactcattcaagcttgccatgaacaagtttgctgcttacacaccatctgaatacaaatcactccttggatttgttccacaaatcaaggctagcaaggctaaaaagtccaacttcaaggtcgatggttccctcgactggcgtcaaaagggtgctgttaatgatatcaaggaccaagctagctgcggttcatgctgggcattctctgctatcgctggtgctgaaggtgcttacttcttaaagacaggcaaactcctctccttctcagaacaaaaccttgttgattgcgttacaacatgctatggctgcaatggtggtctcatgacatccgcttatgactatgttatcaggtaccaagatggtaaattcatgctcgaagatgactatccatacaaggctgtccaaggctcatgcaagttcgatgcttcaaaggctgttggttcaatctcagactacctcgaagttgcttcatatgatgaagatgatcttgctgctaaggttacaaacaatggcccaacatgcattgctatcgatgcttcacactacagcttccaactctacagcagtggtatctatgatgaaacacgctgctcatcaacatccctcgatcacggtgttgctgctgttggttatggctcagatggtgctacaaactactggatcgttcgtaactcatggggcacatcatggggtgaagatggttacatccgcatgatcaaggacaagaacaaccaatgcggtgttgcatcaatggcctgcgtcccaattgcataaataagccaattgaattgaatttaacttttatgaattttaattaacattttaaaacagaacattagctgagtacaaatgttacctcgtgggatagttgttgtatgtggtaaataaatgaatgaatttgaaacacaatttgcgacaaatttttcgaatttatttattttgatattcgcttttttcatgttttgcttatggtatggcactgtgtttagtggtttcatgagtaattattatgtatatttctatagaagatacaacaaaagtcattgggaaattgagtgtttcaaaaagattacaaaaacgacatccaggaattgtttaaagttcgttttgaattcattttctcgacttttgagttcatcagggaacgattttgcaatctttttacacaaaaatatttatcatcaatatttatttgatagtttaacattatttccttttcaaaattgaaatttaaccaaacgaacacaacattttgcgatatattgttaactttctgagaaatgccgtaatgatggtgaaattgggatttatttcatgaaattatgtaaaaacttgcataatcagaccaaaatatcttaaaacgaaaacattaatttgaattcataaatggtctgagtatttgaaaaattgaatccgaacgataaaaatgctttacacctaaaaaatatttttttctcttaggttgcatatattttggttaaaaataaatataacacttctaaatttttataatatgtaattattttttatattaacagtccggttcattactaaaaagccatattatgtgattgaaaatatttcaagcatgattttttcccacttaaatataattttaaaagcttatttttactatctactacacttattattaactataattcatccaaataaatatcgaaaatatgcaaatcagctgatttattgaaaaattgcaatccagatattacaaaccttagtatgacatctccagatagtccttattctttgattttggagtaatattattcagtatcgaaactcaattgattgtgtccttcttaaaagatttagtacatttgtattttttactattaaacgctttaccaacggcgaggtggtcctggaggtggcggtggatggaagaaaggtccaggtggtggtggaggtggaggtggatggaagaaaggtccaggtggtggtggaggtgggtgatgataaactggtggaggaggtggtggcggatgatgataaactggtggaggaggtggtggtggtggatgatgataaactggaggaggtggaggaggaggacggaaccctggatgtggtggaggtggatgatggaatggaggaggtcctggtgggtggtgatgaggtggtcctgggtgatgatgtggaggtcctggtggaggcatctttgtttgtgaaatgttatattttgtcaacaacaacaataattcaataatttgaaagcaccgagtttggatggttttacccgataattcaataaatgactttgttaattctttgcaataaacaaaattattcaaaatttgaaagcaaaaagtggttattgttcaaatcatcgatgatttttaggtgaaatttcaacaccaagaattcttgcaacgatattgttgatttcacctcaattaaagtattttttgttcttcatttttgtttgaattattttgttatgtagcatgcaacctatacaatacttttcaactataaccacatgatctttctttattttttattaaattgatttctccttctcacaaccaagccacatcccatcatgggatgataaaaatttttatccatcatgttagactgagtggttattttttgacattgttgtaattattgataaaaataaataattgtgattattaccgaaaattatgggaaacataacttttacattacgcgtataatataaaaatataatttaatttataaattttataaacatttagaggaattactgggaattaatttttaatatggcaaaataatttgtgaacttttaaattgtcttttttctgttggtcgcaatggaacaattgaaaactttttttttagaacatgaagaaattacaactaaaaatgtacaaatgtttgttgatttcctcagagactctcttaatgaaaacgagaatttaacaatgaatattttagcagatcgcatttgcggagaaaactcattctttgttcttcaaactatgtcaacaaaagtaaaaaacataatgcgaaaaataaataaattgaaggaattccagaatatttgtattgaaacaatcgaaaaatcattttggaagtcatcaaatccaaatttccaatcggccaataatttcatattaatatttggaaaggaagtattttttgaatcaaagaatgaagaatttcttgtttttatatcatctggaaaagatattccatcatgttctaaattaattgaaccatatttaagatcacaacaagcgccaattcccattagttcaggcataaatcatttcccacatgttgaaacaaattcatattcaattttaggctcatatattcttgatgttatttctaatgaaactaactttgaaactatttattctttaacaagagccctttcagaaatcattctaactattattaacatcaatgatattcttaatctatattctgaaacaaaatctccattattattgatgcttaaatctaaactcaataggaactgtttttatttgtttttatcaataacagtctcaggaattccagaaaaatccgaaatcacaaattcaatatacaataaacttctcaattttctatcgtccgaatcttctattgaagacaaaatctttggatatgtgtcattaatgcgtttgaccaattatattcaagactttgaatcatttgtttccaattcgattgcttttatgattcttgactttgattcacgaaatgcaaatatacataattccttagagaatttatatttatccattattaagcgctccaaaaaagacaaaacgttaaatcaattagggaaacaattatatttatcagttgaacaactttcatatcaaacacatttcaaatcttttgtacttcccgacattataacattttatactgattttccatcgattacaaatgagttaattgagctatcacaagatgcatctgattgctcattagttaacaaatgtattaaatcattttgtaagaacaacaaattaaaatccgaaaatttaattaagtcaatcattgaatattcggttcaacatgatgataattataactttaaaacatttgtttcgatatttcagccattttataacttacagccacaaatgataacaaaagcatttgaattatttaatgatattaaatcgaattctataaaagtttggctacgattagaaacactttcaacaataccaaaatcgaaatggccgaattatgatatatataatgatttaaagtatggaattcgacattgtaattatgacttaaaacttttatcatttcaagtattacttaaaacagattttttagcttctgaaaagttattaaaattaataacaaaatatttcattaaaatgatttattgtgattcatcgaaacatatacaaattatattcaatttatttaatgattttattaatatatttaaatccttttcgaataaagaagttgttcataatgtattaaactcatttttaaatgaatttgtttatttaatggcacctgattcagtaacaacacaacgaaaatttggatttgatttaactttaataatttggaaacatttcccaaatatttataatgaaacattacttcattcaatatattcattgttatttgatccatcgacgaaatttagtaaaaatgtatacaatataatatataatgaaatatataaaaaagataacaaaaaagcggaaattttacgtaattttggatttaaagaacaaaatgataataaaattaacgttaaaaataatgaggaaacattaaataaatatattaatgaattaaaagaaaataattccgaaactattcatactcttgagcgctttttaaaggataaaacaattgttttcactgaaacatttctaaatgaaattgttgacaaatttttcgatgtttttattaatacgaaagatgtcggaatttcatatcatggacaatttgtctttgaatcattatttaagttaataaacaatatcgaaatttctcaaacaaaacttaataattatacaacgcaattattaacaattttaagtaatttcgatatggaaaatatgcgaagaagtgcttcattaccatttgtagctttatcattaattagaatatataataacaaaaacaatgataaagttaacttaaatcaaaatcaaattaaaatattaaacgctttaattaacttattaaaaaatacttcgaatgaaatcgaagctacaaacacattaaatgttattcgatttgttctcaaagataaaattacttcttcttatgaagaaacatttttaccaaaaatattccaaataatattcgaaacatccgaaaaattccattgttgggacttcataagtgcattaaacttatgttttgcgactttattacaaaagctttggaagcgaagtgaaaagacaataaatttaatgatatttttccaaaagtttccaaactctaaagaaatattaattaatgcattaaagtctattaataatcatactatatactttgcgataactgttttatcattatttaattcgactaaaaaagaaactgaaatattaaacttgttaataaaacatattgataataagtcgtcaagaattagaagacttatttctaagtcaattataaatgttatacctgaaagtgattataatttactttatgagcaaatattttatatattaaatgattcgaaatatttcgaacataaaaatatttataattattcgaataattattttgaatttgatcaaattattacttcaaattcattaaatacttttattaacatattaaaaatattaataatcgaaaaacaaataaaaattaatgagtttccacaaattaaaatccatttagttccgccttttatatattctgatctcattttgatatataataagttaaatatgaaaatacctaaaattaatataaaacaaaattcgttattttattatgatgaatcaattttattatataatcaaaatgaaattatttgtaatgtttctgattcattattaatatcaattttaaataaatcaagtgaaattaagtcattaaatgaaacttttataaatataattaaaaatagaattgcccaaaaaaatgtcccttatatgttattatttaaatgtatcgattcgaaaatgaaaattttgaaaatttgcggtcccgattgattgctattctttaaaaataatcttaccctaaagttttaagaaaataatcaaaattgaatgtaaaggaatccttcgtccatcctttagtacttttgcaaatatatccagacttataaataaaatatggcttttgcaaaacaaaaataaaaaaaaatattatataatttttaacagtgaaacaaaattaaatttatatgaaatataaattatcccaattcgaggaaataaaaaccaaaattatataagcgaccgttaaggtattgttcacatcaaacattttgatgttctaacacaaattatcataaacatcaaaaaatcattgctagttctctattcttacatttatattctgtcttttggctcatattcatattacccaacgaactcaaacatgctatctaagtatgcaagtaatttcgtagggaaaagactgcattcctttcttactgtcaacgttagtatacaacattcgaaatcatcacaatccactagatcaaaagaagccgaagaatcatcatcaacttggttcaatacaatagttctatttaaagttgcagctgttgatatacagcaattaaaaggtaacaaaaatccattaattgccttcatcaaagcacaactatgagctctatattttttctcgatgaaagtatcgaatacttttttgttattaattggacatgatttaaatctcttgaatagatgtcttgattgtaatttttggaagaacaaataataaagtaatttctcgatacatggttcaggctttgacaattgattattaacttcattcggtgcaacgctaatcaattgtgaaactcttgagacaacatccatttttgggtgttgaattggcacgtcaaaatcaaacggtgacatataaggaggggttcgaactggaattgaattgaaaacatcaaatttacggcactctttggccgtcggacgtttttttggatctatgttaagcatagccgatatcagcgggcggacgtcagcggggagcgcgtcgaatttgatgttggttggaggctcattctctttgtatggaaatcgtttcgagaaaattgagaagaaaagaaccccgcaactccatatatcggctttaaagccatcataaaagcgttgggtaagaacctcaggggcaacgtattgataagagccgcatttccctgttactttatcatcaaaagtgacatatgcaaggccaaggtctgaaagtctaacgcccattttatctgtgaggagtacattttctagttttatgtctcggtgacaaatatgattctcatgtagatattcgatagctgcaaggatttgatctgctattgaaattatgacttgctttgatagcccagatgtcctaaggagctggagaaggtcacctttttcataaagatctgatatttggaatgtttgtgattttccttcaataacttcgtgaatggctaaaatgtttggatggcaaagtagaggagaaagagttttctcgttgaaatctattctattgccatctactaaagaggcagcgacttttttggatgtgatttttgcaaccagtggatgttcaccggctgatttaaagcagagccggatggatgaaaatgagccggatccaatcttctgacccacgagataacgatgaaccttgaagaagctcattttatgtaatttcctgtaaagctgcaataaattgaaatttgaattatatttgaaaattgttatggttttgatcgtcgacgatagaattatcacaaaaaataataagaaagataatatgagttaatgatcatttttttagtacaaagaaatcatttaattatgtattaaaaaggaatttttcaaaatttgattgtatttattataaagagttgtttatttttactttagaaatttcataaaatttttttgtttttgttaggttgataataaaatgaaatattattggaattgcgcatgttgaaagtcaaatgaatttggttttcatagaatttttgattactttaagattttttctattcatatataaaaagttttacaacaaatatatctcttcagtttaagatatcttaataatatgttaatgttttaggaatttattaatattaatataagtaaaaagtttttgtttaatggattttctttttttttttataagtttaaatgataagaattaggttttgataaaatatatcaaaaagaatttatttatattaatttttattatatctattaacgatccgtaatattgagttagttatttttatcagctatttcaattcctccatgttcaattagtatttttactatttcgttgtgtcctgtttcagaagcaatcataagtgctgtttcaaaaattatcaacaattttcatgcattattgtgaaatattatattattaaaacaaattttaaatataataaattaatatctaatatattaatatcaattcctttttgttcaacaagcaatttaacgatattaacatgcccattataagatgcgcaaattaatgcagtccaaaattgcttaaacaatttccaaatattattttttaattccaaagtatttaaataaaaattaaacagaatacgtaaacataatcaacggcattaatatcgattcctttttgttggattaataatttaactatttctgtataaccttcttcagatgcaatcataagtgcagtccaaaaatatttaaacaatttccaaatattatttcaaaattccaaataattaaaataaattacatatgaaataaagtaaatatctttagaattgatatcaatttctgtttgttcaagaagtaatctaactatttcgattttacaatttgaagaagcacaaattagtgctgtttgaattaatttatattaattccgaatttttttataatattttaaattaccaaataaaaaatcaaacaaaacaaataaaaatctatagcattgatatcaattcctttttgttcaagaagtaatttaactgtttctatattaccatcatatgaagcataaattaatgcattccaataactttggaaaatattccaaatattattttgtaatttcaaattatttaaataaaatttaaataaacaaaaacaacatctctatcattaatattaattccttcattttccagaagtaacttaactatttcagtatgatttttttcagatgctttcataagtgctgtttgaattaacatgaattaattccaaatgatattataatatttcaaattattaaattaaacattaaattaaagtaataaatgtttttcgcattaatatcaattccttcttgtgcaagaagtaatttaactatctctgtaaagccattatatgatgcataaattagtgagctccaatttatttaaaaaatattccaaatattattttgtaatttcaaattatttctataaaatttaaataaaacaagttaacatctctaatgttaatatcaattttattttcaagaagtaacttaactattatcgtatgatttctttcagatgcttttataagtgcagtttgaagtagtttaaattatttccaaatgttattattatatttcaaattattacatgaaaaatcaattaaatcatgtaaacatctatagcattgatgtcaattgttttttgtttaagtagtatttcaactatttctgttttaccgcttgaagatgcaaacataagtgctgtataaaataatttgaataatttccataaatttgtttgaaatagcaaagtattttctgaaaatttttgtgacagaaataaatttctttagaattaacttcaattttttcttgtaaaagaagcatttgaactatgtctttatgaccattatcagatgcaaacataagtgctgttctaaatattttatataatttccaaatattatattttaatgtcaaattatttaaataaagtttaaataagataactaattatctttcgcattaatatcaattccttcttgttcaagaagtaatttaacagtttctgtatgaccattttctgctgccaaaatcaaacttgttttaaataattttaataatctccaaaaattattttgaaatatcaaattattaaatgaaaaatcaaatcaatcaaatatatgtctttaacattgatatctattccgttttgttcaagaagtaattttactatttctgtgtatcccttttcagatgctaaaataagagctgtgttaaacaatttgagtaatttccaaacattattttaaaacaaaaaattattgaaattaattttataataattaaataaacatttcttgcattgaaatcaataccttttttgtcaagaagtaatttaactatttctatatatcccttttctgaagccaaaatgagtgctgtatcaaataatttaaataattcccaaatattattttgaaacattaaataaaagaatctaattttgataaatatcaatatatatttttgatattaacatcatttcctttatgttggagaagtaatttaacgatttctgtatttccattttgaattgcatgaaaacaaattgtattaaatattacaaataatttccatattttatttcaaaacattaaaatattgtattaaacaatgggaaaaattaacaaatatttttgatattaatatcaattctttcttgttcaagaaggattttaactatttcgatgtgaccttttttagatgccttaataagtgctgtttgaaatagttcaaatagtcttcaaatataattttgaaatattaaatggttaaaacaaatattaaactaaattaaaaaatatcttttgcattgacatcaattccttcatgtttaagaagtattttaactatttctatgtttcctttagaagatacccaaataagtgctgtttgaaacaacataaatgaattccaaacattattttggaacttcaaattatagaaacttatattaaataatataaatatatatcttttgaattgacatcaatatctttttgttcaagaagcaatttaactatttctgaattgcttgtataagatgcacaaataagtgctgtactaaataatttgaatgatttccaattattacaatgaaactttaagttatgaaaatcaattttaatataaataaacaaacgtttttagcattaatatcgattccttcttgtttaagaagtaatttaattatttccatatggacacaatcagctgcacaattaaaaggagtattaaataatttgtataatttccaaatattattttgaaatagaaaattaatataacaaatataaaacacaacaaataaaaatctttaggattattatcaatttcttcttgttcaaaaaataaattaaatatatcattttgatgatattgagatgcaattataagtgctgtattaaataattaaaacaatttccaaataatgttttgaatcaccagattattaaaacaaatatcaaataaaacaaataaatatctttagcattgatatcaattccattttgatttaaaatgtattggatcagttcaatatttcccgattttaccgaaaaaatcaaaatattttttggaatttgatattcttcaagaaaatatttaacaagaaatatattacctattttagctgcgatattaataatggaatcgttgatttccattccttctttttgcaaaaaggaaaaaatttcataattatgatgcaaaatgcattcaatacctaattcttctaaattctcaatatcaacaaatttattttcataaatatatttcaagatatcattccgatgaaattcaattgctgtttcatatggtctttcaaacaatgtatgactttgttcacataaatgaatgatttcttcatttccacctgcaacagcatattttcctgtattaattaaatttgtcccattcataagcaaatatttaaaacatttaactgatccaaaaaatgctgcataatcaattaatgtaacacctcttttgttaataaatgaatatctttcataaagtgatggtttaattgtttgattaaaatcaaattttgtttgtgatgatatttcttgaagtttttcgatttcatcatttcgaattattttcgcaatttcattcggattaactccttctttaattaattttttatatagtttccaattatcttgtgaaagttcttcgcgactttctttgaaatctttacgtaataaaattttgttgtttgcttctttaaaatttttatataaaatgtaatgaaaaaaatatttttcgttttgactttcaagcactttgggctttaatacattacgttcaatcataacttcaaggagataatgtgattcttgtgataatttcccgagaagaaaatgtgtaaatacagaaaatattttggattttattttatgtttttcttcgaatatttcaatttctttcataaaattaaaatatttattaaaattattattctgtaagataaatgatgaatatattatttggctaataagtaagttaaaagaatatgcataattttcattaaacatattaattattgaaagaaatgattgattagtgttctcttcacttaaatcaagtattattttctgtaaaaattgtaatttttcgaatctattgccttgatttgataagttttcgcatttttccattggccttacaaaaaagtgacagacaaattccggtttaacaaagcattacacacttgtaaaatgtcaactaaagaaaatgaaaacgataaaacgtttttatttcaagatttacaagagctagatgatataatctcaaatttaaaagaagataacattgaatcaatagttgaatcatcctttaatttttatgatcaaaattttccatattcatttaataacattatttcacaattagtttattcatattttgtttctcagatgaaagatgttaatatttatcttaattacataaaagaaattgataaaaaagaagaaaattcaaagaattttcaaggaataattgaatgtttttgtaggtttcttcttaatcttgaaactcatgaatcatattatatacttgaacatatggttgaacaagaattaattaatccaaaagtaataaaaaacaaagaaacagaatacttttcacatcacaagtcgcaaacagaaattaataacttaaaagaaaaaacgatatttagtggatatttcttttcaaacattcatgaacttcaacgaaatgattgggagcttcataagcgatatcttcatgaagggataaatcctctttcaatttctattattttacgacatgatgatattgataaacttcaacaagaagttaaaaatgattttaatcaaacaattagtccatcattatatgaacgatgttcttttattaacaaacttaatgtttcacttgttgattattgtgctttttttggatcgattaaatgttttaaatatttaataactaaaggcgcaacattaaataatactgggaaatttgcagttgcaggaggaaacatagaaatcattaaaatatgtgaggaaaataattcatcttttgttggtgcatatgaagcagcaattgagtttcatcgaaatgaattatttcattatttttatgaaaggaaaataattgaaaatgttgataaaacaaaacttggaataaaatgtatagaatgtggtaactttaaaattttatcatttttattaaacgatgatatgaatgtcgatgaaaatgttatgttagaatcagcaataattggaaatttatatgtgacaaaacaatttttggctgataatgaaattccaaatagaattttggttaattctgtgatctctggaaattttgaacttgtacaatgtttccttgatataactgatattgatgtaaatttcaaagatttttatttgttttgtttcctgtttgattaaatgattttttgtttagttttaacatttggaatttaattaaatttttccaaactgcacttatgtatgcatgttctaaaaattatcaggaaattgttaaattacttcttgaacaaaaaggaattgatattaatatgaaagaagttttttccaacttgtttgaaggaggtgttttattaataaatttggaatttatacaaattatttagaaatgctttaattttggcatcagaaagaggaaatacagaaattgttaaaatacttctcgaacaagaaggaattgatattacattaaaaggcatttttttggttaattttttgtttgttttaatgttttcgagtttgtttttaaataatgaaatttaattaaattacttaaaacagcttatttaactgcatgtgaaaatggtagccttgaaattgtaaaattactttatgaaagaggtggattcgatattactgagactgattttaacttaaatcaattaaaatttctttttgtaaattttacgtttcatagtattattaggaatttattcttttagctttataatgcacttatgttcgcttgtttaagtggtgatattgaaacagtaaaattcattattaaaaatggcggaattgatattaatgcaatgaatttttatttgtttaattttatgtttatttatgtgttttttggtttaggtaaaatttttggagttaaattaaaagttatcaaacagcattaatgattgcatgtagaaattgtactgttgatatagtaaaattgcttcttcagcaagaagacataaatattaatataaaaaatgtttttaatgtttgtataaaatttattaaattgttttttagtttctagataatttttgatgtattttcgtttctcttcaaacggctcttacaatagcttcacaatatgaagcaaaagaaatcgttgaattacttcgtgaacatgcgaggttgaatagaacatgcattttttactaaataaaaatattttaaattatttaaattctatatccattaatattatgtaattcacttaaatttctttttctccctttaatttaaaaaatattataatattttagttactatatgtaaaatttataattataaattaataattaataaaatgaataacttttatcacaacaatttgaataataactcaagtaatttattgtcaaaagcaaatttcataaccaatcgtttttttagaatttttatttttaagtagtttaacttattgatgtacatttttgaactacaaaaaataatatcgaaaattgaaactattgattttaaatcggcacaaaaattaaacgatataaaatgctatctgatttaactgttgttgactcagtcaaataataaagttttcaaacaccgctatggcaaatgctataactttgaaatttaagactatatttacttaaaaaatatttattattttatatttttacttttatgaaagatcaatgggattatttaattgaaatagatgatgaatcatataaatgtcttcttccatcatctttacaagatgaatggtctgaaaattttgataacattaatttattatttgatgataactcaataattccaagaaataacgcactattatttcctcaaactaagctgagctatttcttaattaaatgtcataagaatcgaagtgaaatttgttcaacaaatgaaagtttaaagatttctataggtgattatgtgataattgctgctacgaaaggaattgatattggaatagtaataagttatattgaaaatccaacaaataaagatttaaaaacagcaaagaaaataaaaagaaaagcatggcaatgtgagattgatcaagttgaattaaaaacagagcatgaagaaaaagcagtcgaaatatgtcaaattaaagtgagagaaatgaaccttccaatgaaaataacaggggcagaatatcaatttgatgggagaaagctcacgttttattatactgctgctagatatgtggactttagagagttggtacgtgttctttttcaagtatttaatacaagaatatggatggtttggcatgatggaaaagctccagtgaaagatgtgtttacaagaaatatcgaaagtaatgatttttgaaaatcatcataataaatagttagttgaaattatttaaccaaattttaaataaaatgatccttgcttcagcagagtaattcttgccttatttatgccaacacttattattgtcggttagggcaagaattgtttgattaatacaaaatttttattcaattttaggaatctgtgttttaccacatcacataattttcatggaacaaaaaccagggtatgatcaatatcaaactgcaatggaacttatgaaaaaggaagattatcctaatgccattatatttttccaaaaatcatatgaacaagggtatgcagatgctcttttccaaataggagcatgtacatttaatggaaaaggtgttgaaaaagatattaaaaaaggtcttagcataatccgtgaggcaagtaaagcaggttctattgaagccaatttatacttagcatctctttatttccaaggtataaatgatttaccaaaagatattaatgaagcatttaactattggcaaaaagcagctgatcttggaagtcctcaagctcattttcaacttggtgtttgctataatcgtggctatggctgtgaagtcaatggacataaagcatttgatcattttatgattgcttctaaggatggaaatgctcctgctatggttcaaattggtaatttctatcttgcaggggaacaatggggcgttgttaagaaggacactactaaatcatttgaatggtttgagaaagctgctaaagcaggacacattggtgctttgtttaatcttggtaacttttatgaatctggtgatggttgtcctcaagatgatgctaaagcatttgaatgtttttgggaagcaggtcaaaaaggtcaaatacaagctctgatgaaagcaggtgagtttctaatgcaagggaaaggtacatctattgattataagcgtgcattcgaatgtttccaaacttgtgctgaaaaaggtgttatcaatgcacgttttcatttgggacgtatgtatagtgatggattaggttgtgaacaaaattaccttaaagcgagaatgaattattccattgcagcagaaagtggatgtgttcctgcaatgacaaatttaggtattttattacataagggattaggaggttctgttgatgataacaaagcagtaatgtattttcgtgaagcagcaaatagaggaagtgcaagtgcaatatataatttaggttgtctttatatgaaaggagaaggagttccacaaaatgatgcttgctttcaaatatttgggtgaaggagctagaagaggtgatgttggcgcatatagtaatttgggtataatgtatttaagtggaagaggaacaaatccaaatcctcaaatggcattacattgttttaaaatggcagaaaaagcaggcgatccattgacatatcgaaatttaggactaatgtatttgtctggtgtagctggtgaaaaggatgaaaagaaaggatttcgatatataagaaaggcaataaatggtggagataatgatgcaaaggattccgttttagaatattttaagataattaatccaaattctgaaatggaagaaaaagttaaagaattttttgaaaatggtgcaatagatgatgaagaaaatgataatacagaagaagaagatcagcaaccactcgatcaaaatttatgtgaaatatattaatatatcttcatttcatgaaaaaatttatatttaaagaaatatttcatttcaagtaaaaagtcatttaattcttaaataagaaagagaacaagtagacatttttttttttaaaattatttttatttacagttttttatgatatttaattagataaataaaatccttatatccaaacatttatctaattctttataaaaatcatttgcttacaacatcattctcattatcagactttaggccataaaatgcgaacacgaaaaccattatttcatctactatatctgaacagaaatattttactgctgatctatctgaataatttccacttgagtccattgtttccgatacccagaacgatagccacgatagaacgacaaccgatagaaaaagtgacttaaagaattttgatgttttttgttttggcataattaagaaatttatccatttaaatgcggtgagccaaaagataatgatgtccatgaatgatttagctaatttagagccatctgtttttgattcttgataagaaagatttgttgcaatataacaaatagaaattaacaaaaaaaatattaatcgaaaaattggatttttgataatgacaggtgaataataactaagaataaagaaccagaccatcctaataatggaaatggagaccgaatgtgagatatttatgaatgtcttaaaaccatttgatggaatatatccggccattttttcggttaatgaaaggcgactaccacctgaaatcacaaggaaaataacacagtattgaagaaaatgtggctgaatgccgaaagcaaaaataacaacaaaataaaataattgaattagaaacatagcaactgtgaaaaatataaaacaaaaagtagtgtagtaatcaaaccgttcgcttccaaaagtaacagcaaaggaagcagtgttacaaagagtaagatcacctgataatcgacatgaaactgaaaatgtatcagatttgattggaaccgagtcaaaaatcgaaaaagatgtggtgttggtgatgggaaaaggttttggtgagtcaagaaagagaacataatttgaacgataaaagaacgttgaattgcatgagaaatataactttgatgttataaaactcgtttgttctgtaacaattagttgtattttaacacttgatttttcgtttatttcattatttgcatatgcatcaatattgaaaattcttaaacttcttgctgattctggcctatttgtttcatagcttgaaagtgtgtacgcatttaaatcacaataccatgaaattgagaatagaattatgagtaatagtgcaaataatataaatgaaatatatacatctgagaaagacttatcagcaatatttaaataagaaaattttccttcaaatttaatctgtaatgtttcaaaacagctgggttgagaattttcattaatttcttcctccattttgcgaggagacgtttagagaataattgagtattcaataatttgaatgatttattttattttcatctgttccaatgattcgtcctgaactacgaaaaatgtacgattacactctacaagtacatgaaaacattatagatgtttgtttccctattgttgaaggtgtttcacctgataagatttcaatcgaaaatgacaattcaaattctgaaattatttgcaaacttgaaaatcacataccttttttcgctggtcaactcgctaaacctgcagaatcaatacaaacatttattagagatgggaactatgttattcaacttaagggaatttccataaatgagccaaaaattgtcatcaatggcccaaccaaagctaatatcattgatcctcgttctgctttcttagcctcaatgttatattacgataatgactcactttcaaatcgttatttagacattgctctttccttcaattacacaaaagccatttgttggaagtgccgcaagcttatctacgacgagagctcacaagaagaaggttatcaattacttaaaaagatatttgatatatatcatgatgaagacacatcattgcttattggactttatcttcttcaaactgatgtccaaagctccatcaagtactttgaaatctcatattcacaagggaacaatgaagccggaattgccatagccgaaatttatagtccatattcaactgttgtatatgaacacaaagatccccaaaagtctttgaagattcttgagaaagttcacgaagaaatgcgcgagaatcccttcgtttgctatgacctcgctcaattctatgaaaaaggagagtacgttaaaaaagacattgaaaaagctgaagagatgcgcgaatttgccatttcactggtgcctgagctagggaagaacgatacgttgtgtgcaaagaaggaggaaggtaattcgagattatgtaagacattggcaatcgtggctggtagtgttttggtaattggaattggaatagctgtatacagaaggtttagaaggaaatgaataaagaattgaataagtaattttttttgatgtaaattattatttaagaaataatcacagcagcaattcatcaacgcttattacacacagtttcaaaaattagagctgtgttaatgatttgaaaaaagttatcaaagtgcttatttacaattttttcattgtttccttcatcattgtacagagcaaacaaacaaaacacttgcacaaccatttaagataaagattttttctctggacttaataaaatcacgaataaaaaaaaataatgaaatcataattagacataaataaaatgtttatggaagttctttacaatattggtacacttcatttgttttttctacgaaatcttcccatttcatgtattcatttgtaccaccgaatatcttcaacacctcaccattgaaagaccaacgcacatacctttgttcaccacttttccatatttccattaataagtgagaagcataagggggaatagtctcagtagcttgatatcctaaatatgtcaaaaaagtgccaacggttgagtcgtgagatgacaaaagtgaaaatttgaattggtttccaccgtttacggcttcctttgcgactctgaggagctcacgcatggcataagacacgaaaacagttgtgttcttcttgaatgcaatgtacataaggtcagctgtgatcctttgacatagttcaaggtcttctgtcttgacaaaggatggaagttgttgtccattacactcaagagtaacaacccaattagcaacaagattaagattagaggagctatatgtaacaccaaattcatcagcaatgtgtttgattttgttccacatggtattggtataattaagataatcgggatctgcatcaagtttggtataaatgtctttgatatcttggcaaaagtcactgctgggacgtagaagttctaaatattcacttccacggtttattgtgattttttcaaatggttttaatggtggaaatgctcctcctaagaaagactcggcacttctaagagttctgtcgaaatcggtagaacgagcaaagacataattgttattatttgcatcatttgaatcaaataattttgtggtttcaaagaaatatttgtgatacatttcaccaagttgatgatgttgttccattccttgaagtaaaagatcaccagctctgcaatttggtaaaaattcaactaatcttggatcaaatatttgcttatatcttctatattcagaatcctttgatccaattaaccttggcgcgtatgcgtcttcaccatcacaaacccagtgtcctctttgtgctaatggaagataagcattttgtggtgctcttgcgccatgacgaattacaactgttgcgtaaactaacttcatgtctggtattggagccggcgtcaataaaggtgctacgcactgatattttaatgaatttattgcagcaagaaaaagaactagcattgaaagatgtattcgacacaaaagtgacatttcaaatatctgtcaaaaagtcaaaatcatgaatacaaaaatgtttttttgcgtatcttctgaagaaatgaaagaaattcattaaatataacaaatatgattactcatgctaaaatcatttttaaattttaagcaaattaaagatgatattttaaatattttcattacatctgataaaaaatttttttttaagtaattttttggaaacctgttcgaccactaaaggaaaagataaagtaatatgtgtgataatgaaattctaaaattagataccgaatatacatacatcataattttgaattattattgatcgttcagaccaccccatattttacccttctcaaaagggcaaatcgcattggatggacacagcttatcgaactatttgtgatccaccagcatttaccacagcaaccaaatgcatattacctttttctcaaaacgaatgtattgcagctgctagtggtagtaaacttcaaatatatacttttgatgaagaaggatttcatttaatctgggaaaagaacttttgggccaatattttttccgttgttcgacacaggatgggcgattatgatattttaattttaggatgtgattattcaaaagtagttgcacttcaagcagttggcgatatagatcttcaagaaacggaatttcatcgttttgatgtttgtgatacatccacttgtcttcgttatccacccaaaatgatcattgatccaaatgattcttgcatagctttacttttaggtggtgatcaattattatttcttactttatttgatccaaatgatttttccaaaagcgaacgacctattttagagacaggtcaacattcaggttggaatataatcacaggagcaattcatcataacttattacatgactatgatccaccttttttccgaaccattgacatacgttttttagaaggttataatcgacccacattagcaatagttcatgagccaattcctacattttccgttcgattacccattcaaaagtcgacgatcacagtctccttaatttccccattacttatacgtcgtcgtggtgaacaatcagatcttaagaaatcatcatggaactctcgaccaataccacataacttcatatgtattattccagtctttgtacctcatggcgggtttatagtattaaccaagaatgccattctttatatgacgcatacgtcagggtttgcatatggtttaaactcattagcagtcattgatgatgaatgtccatatgaaatctctgatcattgtgagacgccacatgaaatatattcatcggcatattgtgtcttagattctaatcatattttaatcacagtcgatcaacatgtccccgccatattaacattacatgataatggtattgatattacagggatgtcattatatgttcatgaagattttgaattccatccgagtttatttttacattataaggacaacttaatatttgcagcttctacaattcaagacacatatatgttatcgttaaattatcaaacagaagatatatcgaatagttattttaatgaattccaattaacagaatcacaaaagacattattccaaatgttatataaagaattaccagaaccagtttcacgacatattattacaaaaatggatataacaattgttggagttatatatcaaattggtacagttacatgttctactccatttattaactttgatgatacatcgattacacaaggaattaataatgaagctatttcgatggcattaggttgtgggtttaagaaaagtagttgtttacaatatttaaggacatcattaactccaaatattttagcttcatttaatatgactgatgtaatttccatttttacatcgaattattttgattatgttttattatcacaacaaacatctacagcagtgcgccaactaaatatgaataatttcaacgaattagatgaagaaacattaaaaatatttgttacaaatgagccgacaattattgcaggcgattttatggattcttttgtacaaattacttctacttcaattcgattaattagagataatattttattatatcaattcgatccacctataggtcgagaaattaaaacagcgaaaatatcgaaagattatatcattataatattatcagatcatacagtattaatatgtagtgaaattcttaatgatgaattatattttgtacctttaaacttaccagtaaatgctacaactggtaaacaaccacaaatttatcgattagctatatatgatgattatatatttatgttacaaaacaatcatacattacatatatattcgatatcagaacaaaaagttattgcgttttatgaacaatttaaatattttagtgatttaatatatccgcaatgtcaaattaataattccggatttcaattaattactgttgtagatatgaacataattgaaatcgataaaaagccatttttaataatgttaatgcgtgaaggtaatcttattatatatcaaatacattactttggtaattataactttggtttccgtaagattaaaacacgaagatttacatcgtcaggtaaaacatgtaaatttggatcgataatatcatttacaaatattaatggttattcaggtgcatatatttgttgtgaacatccaatgtatattctctctgaatgtggttatccacgaattattccatcacctattggaatatattgtactcaatatcatcaatcattaatgttaattgataacaatgatattaaattaattaatttcgataacttaacacaaaaagaaacgcatataattgatggatgtatagttcaacgtattaaagttggccaaacaattcgatcaatgacatttgcaccttcatggcgtgcgattatcttcttttcatcatatccgatattatttacacatgaaaatgaaccggacattgatccagaagcttcattaacaccacattatcaaaagccaccaactccaccacgagaatttgatagtattgatggattaccattaaaatatgaagagcattatgacttaaatattattacttccgaaggtattatcaaagcattaagtttagataatcatgaatatggtaattgtgtctcattcatacgtacatctgaaaattatcaagtcccgaattcgacattatcggaatatttagctataggcacaggttatatgtgtcatgaagaacgactaatgagaggccgattagctatttataaaggttccattattcaaagcgatgaaaataatggtaatgaatatcaattacaagaattatttagtaaggttttcttggcgccagttaatgttatcactgaattagatggttatattgcagcgtttattggaggacaacttcaaatgttaatgtttgtgaatgaaaaacaatataaagtagtgtcacaattaaatggacattttatcccttcgcaaatgttatcattgaaaaatttgttgttttatatcgatatatataaaggatgtcaattaattcgatggaggaattatggacacaaattaattactatggcaaaagatttcttaactttctctccaatagctggagctttacttacaaaaaaaggtgttttagcaacttgtttattcgataatttcggtaatgtccaaatctctgatatcgatgaatacgcaataccaattgatgctttcgtgaggaaatcaattttctatttgggttgtcgacctttaaattccggattcttcccaataaaaagcgcaatcagtaatgaaatcgatggacacttcggttggttcgtttctgaccatgggaaattcggtatattatcgccaattaataacgagttggaccgaagaagactttgtttggtccaatctttgttcgaaaaaactctgacagggttctcccacttggagtacagatgtgggaagttccctttgctggaaaaccaagagctgatgatcgagcagccgaggcttgtcgtcgatatggatttgatgatggacttcttggaggcacagcctgacttgcaaaagcaatgtatgaaatcaattggtagaagttcaatcgatttgatcgcttcaattaatgaaatttatggagtttcaaaaattttcgaataaataaaaaataaatatatgacacttttgctataaatcaatgaaaaaatgctgaagttttgttgttcgttttcccataataaaattatttggagaaaattaaaaatatgtttaaaagttgttgaatgggacattgagccaaagtgaattatctgtcctaaaaagtactgtctataaatatttattcatacaatttattaagaccatctgagagcttccataacaagtgattatgcttcatcatgatttcctcatctgccaaacattgctctggcctcgttaaataacatccgactaactctgctaccccaccaggaatacaaagcgcatgcaatccaacatatagaccgcttttgcaaacatcattttgcttagagtcaacaaccgcaagcgaatacccgaaatactttttccacaatggattcgacggatcattttttgttgctctgtttaaagcggattcatacacagcctcaataacatttttctcattttcacatttacacatttttattgcttcatcgaatgtccgaattttagggttctttcgaagtgttattctttcttcttctgttaatacatgtgaagaagtcgtctcaagaattgttttcatctcatgaatggaatcatcagacaaaagacattcgtttaaatgatcaataactccttcgataatgtgcgagaaattatacaaaaaatcattttcccgaagtacagttaatatcgaagaattttcagtaaatggaagaaaaagtccgcgagatgtaaatgtcggtgttgaaaatatgtgataattggataaaaaggagcttgaggtggaatgaagtagacgtgcaaagggaatattatatgtgtttgtggaaaaataaagcttatgaccactggaaagattgcgaattttttgattagtaatttcaccccattgccaaatcataagatgaaatttggtcattatggattgacaacctcctttttcttcttcaatgccccatgaataaggcgaacaattataacctatgcattgaacattatgtggatcctgttttgtgagtaaaataatattttcagtaagttctgtgatattggaaaattctgttgaagtaaatgaagttggacttggaagatacctatttggactgagttcagttatcataacatgattaagaagtgaatatggtgaaagaactgctataactgataaatgtgaattttgataatttaagtcaaaaatagattccttttgaagaacatcaacaagataagcaatgtcgagtgaatgttgtggtcgctgccttaaaggaagttggtaatcctttgggtatttttctccatcaggaagaagtggaattaaagggcatgatataggaaaagcctcgatttcttccattttactcgaacgattaccataccgatcaataaactattcaatagccacaccattaaacttgaagaaaaattccataaaacaaagaatacaattctaaataatgaaagaaacacttacaaattttgaactattactatatgaaatttgttcatttctaacaaaacaatgtttcatgaaaacttatgaagtattttttttctatagcaaaatgtattatttattatataactctaaattaacagatacaaggagatatgtatgtagaaatgaggaaaccattcatcatttgcaggtgcacataaacttttcattgtgcttctttgcattgctcatcattcagttgtattatgacactgaacgtggagttatttgggtaggagaaaaagttcctgtaaaccggcaaagaacgtaaaaaaaatgcggagtgagaagcgcagccgcaattaccatcatcgtttccatcaacgcactttccaacgccatcgatatttactgaatatccataattttcacaaacccatgagcaccaacaataaaactcagttcggttcaattcaaacttatgatctttgtgtctgaatttgccgaatcttctgtcatggccaaatgattttgttaatatgtcattatattcaatatttggagtggtaatatatatacaaaatggacaaatacgatggaaaatttggtaaagagctaattctaaatcatttggttccaaatgttccattaattctaacattgtgataaatggacaacagagattttgatgaacaaaatcattgctaaaattggtaacatcttggttgaataaaaatattggaaatgatcttgaatttgaataaaaaacttgtggagcagataaataattagatcctttttgaagagctcttaaatctttgtcagctccaacaatgaattgtagattccccgggtttcggcttaaataaaaaataaaatcacaatctgcacaaccaagatctaaaacataatagggatttatttcttgaatataacgtaacgcatggtggtatctttgtgtatgaagaggacaaaaaaaaggatttgtgatttgacaggaatccatttcctggaacaaaaaagaccatttttgaatttttaaatactttattttagtgaaaacaaaaagtgctggttcaaagacagagatgatgaatataagtttgtttcataaaaaagatagttaataaacttcataaaatataccataactttatctagttgttttggtttacttttttgatatagataagcttctttttggatgatctattaaatggcaatgcttgattggaaaaaaattcatcaataagaaatctgataataaaatgcaaaaattaaattttatcgaaaaatcaagttaaacatatccattaaatgcgatataaattgtttttgattcatcaaatattatggaaaaaatataactttctccaaaacaacaaatagatttttacgattctttgtacacttaaagttgataagttgatgatattatatccaaacaatgaaataaagtgcattgccaattcctcaaaaaaataggtttaatcaaataaatccactttttgttccagagcaatcaaagatgtctttagtaatttcgccaaaaagaaggatcaaagtgcagaatgtaggtaatttatgaattttgtatagtttacataaaaggtattgagttctttttaccaaaagtgacatctttacacatcttatcaaatttctgacaacctaccgtctatcaaaaattgaataagatttgaattcaaatatttgcggttgagcattcaattaacgttctatggagaaaagaaaaaaagctttttcctggggttaatagagaatttcgaggaaatattttgagaataaaaataccactgtatcaattaataatataaataagtttaaattgcacttaaaatgtagatatcaaaataaaaaatgatttttttattataactaactcaaatccctttcaatttttcagacattaaacaaaagataggaggtttatgattttcttgtttccttgtctttcttatgcattatttgaaattattattgataaaaagattcacattacagcagaaagtttgaatcaagcatattatgaagcattaaacattgataattcgacaaacttttcagatgttgaaatcgtgagtggtgaagttatttataatgaaattgattctgaccaatgggaaatgattcttaatttttctgtttctggagatgttaatattaattcctatacattatacctaattttcttgaatttaatacatgtagaaaacatttacctaggtgttacattaggaactgattccgttttgagtttcatttcttgtagaaatctgaaatatatttcttttgcaaatatttttcgaattgagccatatatgtttttaaggtatgtcaaattgataacagttgatcctcctacgttgtcttatgttggtgaaggtgcttttcaaatgcgtgtaagttttgaatcaagcatatcatgaagcattaaacattgataattcgacaaatttttcagatgttgaaatcgttaatggcgaatatattttcaatgaagtcgataataatcagtgggaaatgattcataatcttactatttctagtgatgttaattttgattcatatgacttatttttgattatcccaatgttaatacaaatagaaaatatttatttgggtattacaataaaacgtgattcctatttgaatttcgagaattttgagcatttgaaatatattttttttgcaaacatttcccaatttaatacaaatatgttttcatattgtaataacctggttactgttgaagctcctacgttggcttgtattggtgagtatacgtttcgaatgtgtaaaaaccttaaatcaatttcatttccaaacgttatagaaatagatgattatgcattttcttgctgtgcagcactacagagtgttagttttcctcaactcaaaaattgtggatctaacgcttttgaatattgtccaatcacaacaataagttttccatttctcagcgaagtttctccatatatgttttcttcatgcggaaacatggaaactgcttatttaccaaatgttactacgattggtgcttatgcttttttgcattgcttcagcttagtcgatgtaaacatcacaaaagttgaatacatttgtgaaggagcgttcaattatgcatacaatctcagaaccctcgaattaccttcaattataaatgttggcggaccttttcttgttgaatgttctaggctaatcaatatttctttacccaatgcaattcgtgttccagattatatgtttgctaatttatcaaacacgttacatatatatattccaaaagttgtttctattggaaaacattcattttgaacaatattttttcggtgagaatacttttgaacaacttaaaatcaaagaaattgatgattacgcattttcaggttgtgtttgttctgatgatttaacatttgattattgtgaatatgttggaaattttgcgttttgtaatacgcttgtatttggtatttcattaccaaatcttaaatcatgtggaaattattcgttttgttcatttggttatattgaagaattatattttcctaatcttgaaagttgtggtgattattcattttcatataattttaatttgattaatgttacatttccttcattaattacgattggagattcgccatttgaagaatgtccaaatttagagatcatgaatttaccaaatttagttcaagtaaatgattattttatatctaatgttaatatgaatcattttgaatttttaaaattaaaatatattggatctaattcatttacgaaagcatgtgacaaagttgaaaatattaattttccagaagtcatctcaattggtgattattttttaaaagattgtcaacgaattcgaagtatttcattaccaaacgtagaaaatattggtaaatatgcattttataattgtagtaatttaattgaagtttcattaccaaaattaaaatattttgactcagaattattttattattgtaatttaattgaaaatatttcattcccagcacttgaaactattggtaataattttttaattcattgttataatattaaaataataaatttaccaaaagttcgaaatattattaatacagcattttataattgtagttcgatttatgaattaaatttaaataatatcacgaatgtaaacgaaggaccgattgctaaatattgtaagtcattaaaaatcattcacatgaattcacttgaaagttcaccaagatttttttatttgcgcacatgcaaagtcttgaagaagtttcattaagaaaaattaaaaaaattacgaaaagttatttatttttataattgcacaaatttacgaaacattaatatgccaaactttgaaacaatgattgaatctgattcaggttatgaatttgcatattgttcatcactcgaaacaataaaattaccatcaatagaagaattctatggtcgaaatacatttcagaattgcacatcattagtagcaattaacttttcaaaagcgataagaattgtcgaatatatgtttttaaactgtattaatttgatttacattgaagtacccaaagttacaatactttcatcatattgttttaaagattgcatatcattaaatgaagctggatttacaagtgttaccttttttgaaggcgatggacatttttcaggatgtgttaacttagaaaaaatttatcttcaaaagttaaatgaagtatcaaataacgcgacaaaaatatttgagaattgtaaacgcttaacaattatttggttaccatcttctccaccaaaaacatttaatgaatatatattttcaactataaaaaaaggaaacttaagtatttgtttgccagctaaagacgcttatgaaaattatggaaacgattgtggtgtatcaacatgtcctaaaaattattggaaaggaataaatattgaaattgatgatgatttaattcaggaatgtatttatttacagaatgataatggcaacaaaatactactcattgcactcttatgcatattaattccggcttttttggtaatatgtacttatatactgttgctttacttatttaaaaagaataaacaagaaaaagaatcactcgaaactacgcctcacttaaatatttcgatcattgatcccatttaaagaatttcggttttattattaaatattatgtctatttttttaattttttatttggaatataagcagaacttatagcatgagagttttggtataataatttgtaattcaacatattaaaatatttttaaattagtggtctaaaacatgaaaaatattataatgatgcaagtgcagctgttaattcagatgcagttgtagttaataattgggacattacaaatatttgcactgcttatacagcctttcaaaccattgggtgtaaaatgatattatttccacaaacattaacaaacggaattacgttatccattgttcgatatggacaatctgtagatgaattaattcaaattacttctttagattcaggatatgtatatgattgtgatattactatggatttgataacataaacttttacgaagtcaaatactttttctcatacatttacatcatctaatacattttcgaatacttttacacaatcaaatacattttcgaattcaaattcatttactcaatcaaatgcattcaccgaatcgaattcattttctaacacatttactatgtcaaacacgttctcacaatcaaatacattctcaaatacattttcaaattaagatttatttactaagtcaaatacatttacagaatcattaaagtttaatgaacgatatacgtattccataactataatatattctattgtatttgaagagactcatagtatgacacaggtgtataatacagctacaataataataatcgtagtcgtatgtatagttgtagttattgtgatcatatgtttagttgtcgttttatatattcgtcatcaaagaaataacatacagcaaacagaaaaggctgaaagtgttgaatagaaactgaaacaactaaaatgactcatatttgatgacccatttgcagatgatttcgtggaagataatcgtataaacatctgataaattaaatagctttagtaaacatttatggtttgtatctcaaaaatttttggtttccaatatatttgggggtgcccacaacgatcgtgatgacggccgtttatttcataattttgaagaattcaacaattgttttacacactttttaattgagttcaatataccaatatattttcttgctattaagcatagaaattaggtgtgacatctacaaaatgtgtattcattgaagaatgtatgttaacatgtagcaagagcaaactcattcatataatgataagaaattggatgagaaaaatatataaaacaattaatttttttcagtaaatgatttttggatttgttcttggcttttgttaaatcgattttgcagcaaaaaacataaagtctaaatttgagtgctttacctgtttcaaaaaaattaaaccgaccgtatataaacttccattttatgcgagaatgaacaccaaaaataaaagcttgatcaaaaaacttttttgagtgatactaagtatggaaaagcatatatcaatatctttttgttactctaaataaaaaagttttccaaattcaatttatgatatcttatccaaaaaattataaataatcataaatatataatttattaactcaaataccaaaaataatatcatacgatttgttttatattatcgaaacgatattgtttccataccgaactttgactgttttggaacaacatcgattccaactcattattcacaaacaaaacatttaaaacagcgttttctgtatcgaacataattaactttggtgtcaactcctttgtattatttatgtcgcgtctgatttcgaagatagttcttttcccagttatgtcccatcctctgattacattatctccgccgcccgtaaacagaaactcatgtccaaaatagttaccatgtgtcaatgatattatagggccttcgtggatgaagaattggtttattgaacagaggcttttaatgtcccattcattggcagtcatatctttggaaccggaaaataaaattgttccatcttttgatgataatgaagtgattccatcaacatgtaagattaaccggccaacgattttgcctctttcattcatgagatgtatcgtgggatattgatcggatgctactgctaagactccatctaatccacaaattgatgtaacaggacttctgccattaaatgtggtacaaaatgtattatgtggtttcttgccgcgactccaatcaattaaatcaaaatttaagccttgtctacgggctatttcttcatttaaattattcttaaatgtgtctggattacttgaatttgtagcgccaggttgatccttgagccaaagggatataacacggtctgttccaacaactatatattgatcccaaatacaaatgcatgattgggctaaacaacgagcaccaacttcaaagttatcaattggctcaagcgtctccatactaaatgattttaagcgacaatcagcttgaatccatatttttccatcggattcatcgatgaccattgaatttgcttctttgaaaaaccctgttgatatctctttcccaccatattttagagtgtgactactgtttacacggttcttataaacataggcaaatttgctctgagatgaaaaacaaccgcactggatgcccgttaactcctcttcgtttgtttggcactttcctttgtaaaagttgagaaggggttcgttattttctatactttttgggattttgcgggaaatgggccattcaaagaggatttcgtcagatattttctcgcgtaaggtttggatttgatcatgtcttttacccgcatatgattctgatgtaatagataacatacgagttacaccaaatgaacttggtgtagcaatttgattgtttctgttaattggcgaaatgcgatcaattttaagttgatcatgcatttgtcgaagaacttcattaaatcgaatttcaatatcaaataacatttttaatcgatcattatctggtttcttgatttgagagttggcccgatgactcaaatcaagaaggacattataatgtgaaaattttagagaatcaagggtatcaaaatctaaatcttcttttggaatttctggaagtttaggaatatcatcttctgcttcatttgtttcttcgcgctctgaaacatataaattaaaatatgtgtttatttcttcttttgctggaatttgaggaagaacaaattgattaggagaacttcttagagcctgaacttctgctgtttctattgggcgatcctcattttgcgttggctctggttcatctacttgaaaactaggtttgatgtttggatctatagcaaattgtggagttatttgtggggttagaattctgtctgttttattaaggaatttggttttattattattgaaccaaagtcggattttcttttggggccatctttctttatctccaagttcgttaaatgttttgtcaaccatttcttttctttctttagatcgctccggtaaactaaaataatcctttaaccttggaattaatatcttaaattcatcctcggtaggatattgcctagtatcgtcaatcccagaaatcattagatagctctgacatgctatatgaaatatctgtataaacgcgccaaaaaaaatgaaaagaactcacagattatcacaacctataattagtaaaaaaattgaaccaccaaaaaagccaaataaaaataaatcaaatcaaatgccaaaaaaagtttttgaaaaagaaattcaaaaaaaatcaaattatgcattaaaatatgtcactccatcaaatcctaaaagaagaaaatcttatgcatttgacatttcaaatgaaattccgaaattaaatgttgatattccaatggtagctcaatcaaatgataactttgattctgaatctgaagcttcggggtttgttgataatcttgacaataaggatcctgaagagatataccaaatttttcaaaatttgattacaagatataaaaatggagtaaaacagtttcatgattatcaaaagttaaagactcaaactaagaggcaaattgcaatgcttaaggatacagtagatgagctaaatattatccaaaaaaaagttgatgcagaatatgaaagattagatctagcaaacgtaccaattatatctgatgaaggcaattaagaatcaaaacatgttgaataacaagaggtagcaaattcctgagtttcagacttttatatgaattattttgttttatttcttgaaataaaatctcatgctttcactcaaacaaaaatcacatatttgaggttggtaatgaatttagttctgccagaaaggctcaagcgattttcatgtccttgtaaaaaattattaaagcttcaaataaaaatgcaaataatataaataaacagtgcaacatatatactatttcatttatgaattttatgataaattattaagaattgaatgatctcaaaaagttgatgatttttaaaaaaagcatatttaagacctcccattcttatatatgttgattcatcataggtataataaagtttcgttcattagaaaacaaaaacattaatttaaatttataaatggtctaatcacatgagaaattgaattcaagacgatcaaaaactttgagtgtctggaaaaacaaaaagttttatttaaaactgaatgttatgatatatttcaaaaataagttatatttctcttaaaaattttagaatgtgtaataattattttttatatcatctgtttggttcaatgctaaaaagtgactttttctccaattaaatatgatttaaaagctcatatttattatatattccatttatattatttactataatttatccaattaaaaattcaaaatttgaaaattgacttgcaaatcagctgattttttgaaaaattgcattccagaaaattggtaagaaagattttaaccaacacttaatataatatttatatttccacaaagtgattatattttgagtttgcagtaatataaaaaaatttccttcttttgtcacttttatgtgaattttcaattgttttaccatatattacaaagattatgataccctcgaaagattctcgtgtccaaagatctattaagaaaaaacgattaataaaaaataacaatcacaatgaatggcaaactcttttatcaattagcaacataatttttagtttagacgctaataatatttctcaaagagcaaaatctttaataaatataattgatgatacatatccaattacattcaatatgattataattcagatgacttgttcattgtttgctacgaaaatgcatgatattaacgtatatttaaaatttttaaatgaaattgaaaaacatgaagaagataaaaatatcaaatataaaatttttgatgttttcactattttcatagtgaatcatactaatgaatcaaattttattctcaagaatttgtgtgaacaagattttattcaacataaacttaaaaaatcatttattcctaaaagcaaattattaaatttttttacttataaacaaaataaagaaaacaagaaaacactttttgacatcgttactgaagaactttcaaagaatgattgggaacttcataagaaattaattagagaaggagttaatcctaatgaaattgcaaaaatcattcgaaatgatgaagtagaaaaacttcaagaaatatcatcacaaacaaattttgattttaatcaaacaattaaaccatcaccttatgaaagatattcatttattaatcataaaaatgttacattaattgattatgcagcattttttggatcagttaaatgttttaaatatttacttataaatggagcaaaaatagaaaacacaggtaaatatgcaattgcaggcggaaatgaagaaatcattcatatatgtgaacaaaatcattcatcatttgaaaatgcatatgaaacagcaattcaatttcatcgaaatgatatctttcattatctttttgaaaataaaattgttgagattgaaaatatagaagatttaggaataatatgtattcaacaccataattacgatatttttacatatttacaagaaaaagggatgaaaatttatgttaattttattgttgaagcagcaaaaattggtaatttatttttagttcagcattttctgaatggaaaacaaattccatattatttaacgaatcaatattatgtacaagcaggaaataatgaacttgttgaatatattcttgataaagaagatgctaatattcgtgaaaatattattttccataattttatgttttaaaaaatatttaaaatttatttaatttatattgtccattgattatagctgttgaaaatggatttataaaaatagttaaattatttttggaagaagaaggaatcgatgttaatatggaagatctttatttgtattatttaaaatttgttttgataatttagaatttcaaaataacatttggaaattgcttataatatttaattcaccacttattgtagcatgtaagaagagatatgtagaaatagtaaaattgcttgctgaacatcaaggaactaatatcaatattaaaaatatttattttttttatttggtcgtaattttaatacagcacttatgttcgcagttgagtataattatatagaaatagtaaaaattcttgttgaacataaagaaattatgattaatgctagaaatgttgatttatattatttttggtttctattaaaattttcgaataacaaaatagtatttggattttatttgaataatttcaaacatcacttatgattgcttgtgaaaaaggtttgacagaaatagttaaattacttctagaacaagcaggaattaatgtcaatattaaagatttttatttatcttatttagtagttgtttcaataattatatgtttcaaaatagtatgtggaatttaattaaatcatttaaaacgccacttatttatgcagttgaaaacgatcacaatgaaatagttcaattacttcttaaacaaccagaaattgatattaatcttcaagatgctttctatttttgtatgaaatttctttcaataatttgagaattcaaaatattatttggaaattatttagtatatttaatacagccttcttgaaagctgtctgtaataataacatagatatgatgaaattactttataagcgtgaaggatttgatatcaatatgaaagatataaaattctttcataattttctgtttcaaagtaataaatgggatttatgattaatatttgatacagctcttatgaaagcatcatatgaaggaaacgtagaagctgtaaagtttattcttgagatagaaggaattgatattaatgccgaaaatttcaccattttttgtatgatttttattaaaacatttttatgtttcaatataaattttggaaattattaaatatatatgatacagcacttattaaagcatcttataaaaataacataaaagtaattaaattactgctggaacaaaaagaaatagatattaacatcaaaaatatttatttaattaaattaaaatttaacaaattaatttttaatttcaatgtaatattcggaaattattctatttgtttaaaacagcacttatgaaagcatctgaaaatggttacatagaaatagtgcaattgcttgaatgaattccttgattaaagaataaaacttaaaacttattttaaaatataaaagttgaactatttttacttttgaaacatttataatgattaatcacatattatacattaataaaatgatattatttttagccattatactcaacaatcaaagatcattgaaaataaaatattttattttattataaaatataaatttttagaaactgaatagaattttgtgattatgatgaaaattaaaaacaaattacatgaaaataaatcatttctggataagttaaattattttactaaacttttttatttttcttcatctatacaaatataaggattctctttttttttgttattagttctttttaataatgtctaagatgataaggatgttcttcaacaatgtttacagtcaaccagacttattcacaaatattctatgaaattgtcaattttgatatgacgtaaattttttactcaggattacaaacggtcgatattgaaagacaaaaaaacaataaaaaaatgaaatccaacgacgaaaaaaagggaaatcccgaggtaaaattcccattttatctcccttcatcaaaagatccaacacttatgaaagataattcttctcattatgcacttttaacatatccaagagatgaagttatgattcctgcttgtaaaatcattgtaagctatatcgataaagacccatcagcaattcctttaaattctaaaaaaagaattaagtttttaatggaattcttagctgttgcattatcaatgaccattgatgatcataaattaatgcaatgtgccctagatgtttatcatgagtttcttaaagacatgtctttctttgggtcaccacaaaggcaaaacaaatatattcgaaggattcttatgcaattatcaattccgtttcaaatgaaccatccagtttcccaagacgtcacaaaggatgctttttattcggttttgagtggtattttatattgttataatgatattcatttaaattattctcgagtattcgatcaagaaacatggattgtccttattaatacccttattaacattttggatacaatcacagttaaacattctgcaacacttacattgattcttggtgagaaacatcattcactcaaacaagcagtagcaaatgtactattctcagcattatataccagtggaataaaagaagatcatgtatggaagcgtattggaaggtttttctctgattggagtaatgacattgattttattaaatcatggggtgaaaatactattcgattattcaactattttcttcataaaatctacaatatcccaatagatgccaatagtaatccatttgttggtggtatttttatcaaaggaaaagaaattgatgatcaatcaatttcttatattcttgttaattcagtatcgccagttgatggaaacaaaatacactcactcaaaggaacacttgatcaagcaagttctatttgtgaaactctttataagatcgcacgctcggcatcaaaaacgttatcaaaattgttaactaaccgtttccccgctgtcacttttttacaactatttggcaaattattatattctgacattaaaaattctgaatcaccaaaagaagaatttgatgttgttatatccaaaaacatcacgacgatgatgcgaatcatgaaacattttgaagttgataattccgagaatatctattataagatgattacatatatcttaaaattccttaagaaagaatatcctttttgtatcaaatcattttataattatttatccaaatcgttttcacataattatcaatttattccatacctatcagaagtgtcattattaaacatgcagaacattgattattcagaaactccaactgatttattcgaaccaatgaaacttttatcgaatacatttgattcattaattagttcacaagtcatattacgtaatgacaaaaagttttctgatatgtatagtagtttattagacccatttactaagtttccatcacattacaaaatcgttttatataaatttatatgtaattcatttgaacttattgattatcccatctttaaacaaataaatgatatcttttctaacttagagaattatgaacaaatcgaaaacggaattagtttcatctccggattaattaattacattagcgcaataattcgagcgcgtccacaattaagtaaagcatttttagaagaacatgtcttaaattcgattttggattgcgcgaataaagtcaaagaaaatccacacgtattaatatcggttctattgttgttaataacattaatcgaatggggcgaagacatattccatcagagacaagaactcgaaatgttttatccgttttataataagttaagcgcttatttagcgaataaagaatcggcaaaaacttataattatcatttgccgattattaacttgttaagtaatattgtagtgtcaagaattgatgcacatattccaatccttgattacttctcaaggaaattggactcttcattaacaattaacgaagaattaatcatcaaaaaatacgcaattaataacccggtaataaattattatacggtacaagaaaaattgttggtttcattcatcgaaaaaagtgacggaactgggccgttagtggtgttcgctcgtggttctttcggtaaaacaatttggatcgtatcggataacataaagtcaacttcgcctgagccaaaactggcaaacgatatcgtcaaaaccgctctgccgcagccaccccaaattgatgtgaagccgatacagctccagggcaccccaatcgaggacatttcaaaagtgaatttgaatgagttaaaggctgaagatgataagttattacaaaagtttggaaaagaatatcaaacttggttggaatgggattactttggattttatccgaatttcaatcaaccaattgttgcaaaaagaccaaaagtcattgatttcttaacaactattggtattttggattcgaataactcactttccgtaagattacaacttaataaggaacatgtgttatctgttataaaacgatttgatgaacttgaaaaattaaatgtaaatgttattccagttttacatgttacttgcgaagatgatgccctcttgtttaagcccgcacatcataagagagtttcgcagttacttcagcaatttatgcgtgaaataagtgagccaatggtcgtaagtgatactgcggctaaagatcacaaattacctcctttaagaactacggtacctattatcccatcttcaaactctgtatccgctttagtatgtccttccatggctaaagctgaagatggcgcaaagaccattttcaatatggcacgcgaatcggttatacacataattttcaatgaaaccgatttcgatctgaaaattagtaaggattatctgaaaagtgaccaaatggttttgatcataaaaccgacattaaacggtctctatcacgtgaagaaattatccaactttaaggatatgttaacaccattcggtgaacaacagacaatgacagccgaaggaatagctttcggtttatcaatatgcggtgatgcaattgtgcctttgatgtctgtgaaagaatttaatgacgcatgcaataagagattagagttaataagagaattatgtaatgttccaatagtgaaggaactgtcagttgtggcggcgacacaaatttaataaaattctttttggggaaattttacacttaactattttcataattaaaattcatagtttggtatcattttgctaattttctttttacttaaacagaagaaatttgtaatatcaaataattatggatattgtttttaagaagctgaaattaaatttaattctttttgggaaattttatcacttaacaattttcataatttaattcatagtttggtatcattttgctaatttttgataattttctttttacttaaacagaagaaatttgtaatatctaataatcatagatattgtttttaaaaagctgaaattaaatttaacacattcacaaaaactttgcttaatattttaagcaaacaataaaaaattaagaatatatttttattgattcaacaatttctagtttcagtaacatattatttttttgttttatataaacaattaaaagttaaaaaaaaaattattaattattttcatatttacaaccaaaaagaaattcattttaaagtaataactctattttacatatgtaacttaagtcatattggcaatttaattctcttttcctttgtcttaaacagttcctttccgtagtacaggagtggccttggcggtccctggttccatctgctccaccaaatccttgttgcggtacagttcgggcattccgttccatatatccacggggcgaaatacaaatagcacagcacgcacagtatgatcagcgtcatgcaaacgaagcctctcacagatctcaatctaaacattcgatcgatcaaagcggacaaattcatcgaagcgaacatcaaaggaattaaataatgataatgaaacattgttcttggaacgcccaaaaacggaatatatgaaacagcccatgaaagcatgaacaacaagttctgccatccagctctcttgaacaacagcgacggaaatgttatcaccattccgaagaatgttgtccaatatattaatggagatcccatgcaacaaatgcgtcgattcggcttcgaatagaaggaaacgtatttgtcgccaagataaggccaatatttggggttagactcccacggatgaggaatcttgcttcgcatgtttatgccgttcatgacaatgttccaacggataaaccgtagcaaatatgaagatcgggaaactcgattcccccaataatatgtgttgatcttcttcggatcagcaatggtgtgggaatcttctttcttgatgtagtagccgtgatggccggaaatgggagtgatcgcaaaatggattaaccaagaaagatatgtaattaaaaaggcaggcataagaatggcaatggcacggataatgatttcgaaaagtgtgggctttgccataaaaatccaaattatttgtgatatgccatcaactgcaatgaggccaagagctgtaaatttgcaagaaccggccatcccaagtgtaataccagctaaaatagcaagtacagtccctccacgtcgaataaataatgaaaaacaaaagaaatgtaacgcacaataaaaatgaagaacaccatctgagagaataaacttgctctcaactatcatggaggtgtcaagggctacaaataatgacgctactaatgaggaaaatggtgtaatgtaaagtaacctacaagaacaatatattaatggtgcgcaaaaagcagaaaaaatggctggaaccatcctaataataacataaactgtttccgtggtggagtattgtcggcctagtcgatcaaaatgttcaatttcggtgcctttgtaaccttgaagataggttagaagagaaatggtcatttttgcaagaggtggatggatgtcaaaatgaaagagatgttgaatgtaccatttcgtaaaatttccaaaatggacttcatcaaaaatgatgcaatctggataagaaattgtccaaagccttgtgtagagagagacaattccaacaattagtacaaatatcacatcaattgccaagaatgccgagttttgatctttttctctcattaaacaacgatcaatttttattcattttttgaaaaccacacaaaaattcaaaagttagtaaattgtttgtttgttgcttgttcgctagatattgtttctcagtgccaaggttagttcattaaaatattaatgataacaaattagaccaaaatgcacaattgatcaagtgcagaccaaaataaccaaatttattttaaaatcactaatcgaaacaaataaatggggtttattttctctttctttttatacaaaacaaagtaaaattacttaaccaaggttgtgatgtaattatatttattttgtcttgaatctgtaaacattgatatattcatatttttttttaacgtcatataatatttgaaattaacagggataatatttatatattttgtttcatcatgttacattttgtttcacctggtactttttgatatgacacaaaatggttctatttctgtaatttaaattgttgtatatttgatttatatctatttttttccatttatttttttgtcatttccacaatatcaaaagattttaatataatgatattgtatttgcatgcaaacttcaaatgttttttttattggaataaattcaaataaaattaaaaaatataaaccaaaaaaaaaattgtttatattgccatgaatgttcttcatttcaatgaatatatttgttttataaatactatattttatgtgtttttcatggaaaattcacttgaatttactgatataaaatcatttatatattattgaatttctttaaatcggatcaataatcgaaatatttaaatgaggcacagtctccagtgattctttttcttttttatactttcgacacaaataaataaatagcacgtaactacctatgaacaacaaaactacaactcctatacatataagtaaagtatcaatccaagtccaattcgtctcgtgatatctatgtacattacattttcttgttaaatcgtcattaagtgtgatatttattcctttccagtaacctgtgccgttggaaccacttgtataattaccataatatatatcatagtataagcaaatacttaagttttctttagttgtagttgaaaatatattttcattaaatgtttttggtggagaagatggtaaatatataatcgttaagcgtttacaattctcaaatatttttgtcgcattttctgatacttctaataaatttggaagattaattatttctaagttaatacaccctgaaaaatgtccatctccatctaattcattaatattcaattcaatgctttttaatgatgtacaatctttaaaacaatatgatggaagtgtagtaacgctatataaattaacatcaatcaaatcaaagcaacctgaaaacatatattcgacaagttttgttgttttagagatattaattacgactaatgatgtgcaattctgaaatgtatttcgaccatagaattcttctattgatggtaattttattgtttcgagtgatgaacaatatgcaaattcataacctgaatcagattcaatcattgtttcaaagtttggcatattaatgtttcgtaaatttgtgcaattataaaataaataacttttcgtaatttttaattttcttaatgaaacttcttcaagactttgcatgtgcgcaaataaaaatcttggtgaactttcaagtgaattcatgtgaatgatttttaatgacttacaatatttagcaatcggtccttcgtttacattcgtgatattatttaaatttaattcataaatcgaactacaattataaaatgctgtattaataatatttcgaacttttggtaaatttattattttaatattataacaaagaattaaaaaattattaccaatagtttcaagtgctgggaatgaaatattttttattaaattaaaataataaaataattctgagtcaaaatattttaattttggtaatgaaacttcaattaaattactacaattataaaaatgtatttttaccattattttttacgtttgtttatgaaatacttcgaatttgttgataatcttttaaaaaataatcaccaattgagatgacttcgggaaaattagtattttcaactttgtcacatgctttcgtaaatgaattagatccaatatatttttaattttaaaaattcaaaatgattcatattaacattagatataaaataatcatttacttgaactaaatttggtaaattcatgatctctaaatttggacattcttcaaatggcgaatctccaatcgtaattaatgaaggaaatgtaacattaatcaaattaaaattatatgaaaatgaataatcaccacaactttcaagattaggaaaaatataattcttcaatataaccaaatgaacaaaacgaataatttccacatgatttgaaagatttggtaatgaaataccaaatacaagcgtattacaaaacgcaaaatttccaacatattcacaataatcaaatgttaaatcatcagaacaaacacaacctgaaaatgcgtaatcatcaatttctttgattttaagttgttcaaaagtattctcaccgaaaaaatattgttcaaatgaatgttttccaatagaaacaacttttggaatatatatatgtaacgtgtttgataaattagcaaacatataatctggaacacgaattgcattgggtaaagaaatattgattagcctagaacattcaacaagaaaaggtccgccaacatttataattgaaggtaattcgagggttctgagattgtatgcataattgaacgctccttcacaaatgtattcaacttttgtgatgtttacatcgactaagctgaagcaatgcaaaaaagcataagcaccaatcgtagtaacatttggtaaataagcagtttccatgtttccgcatgaagaaaaacatatatggagaaacttcgctgagaaatggaaaacttattgttgtgagtggacaatattcaaaagcgttagatccacaatttttgagtagaagaaaactaacactctttagagctgcacagcaagtttttacacattcgaaacgtatactcaccaatacaagccaacgtaggagcttcaacagcaaccaggttattacaatatgaaaacatatttgtattaaattgggaaatgtttgcaaaaaaaatatatttcaaatgctcaaaattctcgaaattcaaataggaatcacgttttattgtaatacccaaataaatattttctatttgtattaacattgggataatcaaaaataagtcatatgaatcaaaattaacatcactagaaatagtaagattatgaatcatttcccactgattattatcgacttcattgaaaatatattcgccattaacgatttcaacatctgaaaaatttgtcgaattatcaatgtttaatgcttcatgatatgcttgattcaaactttctgctgtaatgtgaatttttttatcgattatgatttctaataatgcacaagaaagataaggaaacaagaaaatcataaactttctatcgtttagtttattgattgaaaaattgagagctccgaccccaaccgtaaaaaacgaaaacctaacaaagggtgacaaatattgtcatacgatcaaatatcattcatttgaaatgaacgataacttttaggtcaaatcgttaaaaattttggaacaaaatcgattcaaatgaccttattacatttccatttttgaatataaaaattagacgataattgtgtcaaaaacgcctagttaaggctaacgatggaaaaagttgattcagagcaaaaagctgtttctatatttgatgatctgtctgatctatgcattccatgcaattccatggaattgcaagtttgttatgatagatttaacataaaaaaataggaagcattgattacaaaaagttcaatcttccaaaataaatatgaaagatttgttatttggatcataaaaaaaaatttcataatattttgttcaacataatagagaacacacaattcattgtgtttgaacttaaaaattactttagtgatatccatggaacaagaaattggatttcagttgaacaatttgaagttgatatttcaatctcataagcaatattattaaatgaaaatacggaaaaaggtacagagaatgttacattgacacaattaactcgttggcaaaagaaatttttccaatctattttacgtgctcgagtaaattacataatgcgcattagtataccatttattcttttatatactttaacaaattaaaatggaaaatttcattattacaacatatagaacactatccgaatcaattcttgaaggatattcagaatttgagttcgcaaaacatcttatgactcaatcaggttcatatagaaaagcattaaacatatttaagaacatatttttctttaataaaaataaagttacaatatattcatcatatttgtacatgatgcattaatcgcttctaccaaatcaagtcaatcatatataacaaatggatctaaaatcgcattatacaaaatcaaattaaatggaattatgatcgaatatgaaattgaagaaattccaattgtttggaaataattggacttttaagtaatcatgttaaaactaatggttcaaataaaaacatcaaaattgacgtaaaagatcaaaagttaattgaaatgttacaaacaacacagataatggtaacaaaatcaacgaaaacaaaaatttatatgaagatgttgaatataatttctaacaaatctcaatttcattttttctattattaccttcacgttgtatatcgcaaacatcaatcgacaaatgttcctaattatttacaagaaattcttcattatatttggtaccaagctttttaatttattcaaattattcacaatgaatcaaatgaaatgaaaaatccacgagcgaccgtttgaataaaattcaaaatatcatatcatatatttcatgtgtgcatatcatatatttcatatgtgcatatcatatatttcatatgtgcatatcatatatttcatatgtgcatatcatatatttcatatgtgcatatcatatatttcatatgtgcatatcatatatttcatgtataaaaatgttatttcattgttagtatgttgctaacgtgtatatcatgcttattatgaataaagtcacattttaaaacaaaatacaaatgattcaatgataaaacgataggtatcgttaattgaaaaatgaattcattcaatttattttgtcatgacattaagaaatttcagaaacattcaaaattcatagttatcgtttattgaaaattgagtttattgaaaaattgaaaagtttcctctgaattgaggaagccacgctcggcaccccctaattttggttatatttgtacaccagctgtacggaaattctcaaaaatcattcaatctctgagtaaactattgaactaaaatatccgaatgcaaaaaagatcaaaatttgccctctttggctagaagctaccgtcaagacaatccagcaaaggagaacaacgccttatcgtacacgcgaccgttaaagcccgaagaaccctatcgttgccgatatgaagcatcgaatccagacttaattcggcatactgatctcataattataacggttaatatttaatatcttatatagatgattattctcgttacgttgtttattgtgacgcaatcttcaacgaattctaagcaactacaaaaaagtgcctcgaattagcaattcaatcttgtggcaaccgtccattttctgtgtggaccgataatggtgaggaattcaaaggagattttaagaaattcctcgaagaaaatggaattaaacaagttgcatcagaagtcaaaaacccacagcaaaatgggaaatgtaaaagattttggggtacagcagaaaaatgcaaaaatattgaagaacttagaaattggaaacattttacaacaacacagctcattgtggactgccccaaaaaaccgtcaatgatagatagacgtaggaaacacctcatcaaaggtatttctatggcgttaaatggaatcctacaatctctcctacatggaaagtcgatggagtcgtcgagccatttatcccatatggagcaaattgagtaaaacactcaacaacaatttttttttagtaattgcgagcgccgggagcgagagctattgtgatcgtttccctcggaaaaagcctggctttttccgagggaaacgatcacaaccgcactgtaagtatgcgggaaattgaatagtttactatgtaattgaaagatttttgagaattttcgtacaggacataaatttttataaaactaagttcaatttttttctgaaattaattttttatactgctctttagtaagacatatatatgattattttgtaaagcacaaactattccttgatttattgcataagctatatcatcttgcttattatatttttcaaaattatatggcattcgaaataaactccaagtactaaaatatttttcttcaacattctttataaaatttcttgcaatattaacgctaaatttcttatgagctttatttttggtgttatattttgaacctaaatatgaaaatttttcttctggctcaaataaatgaacattagttctaaagattagtgaaagagtaatgatactatacattaatttcatggcaattgtatttcccagatactgtaaaaattcaagtaatccgataaagaaattaatgagtattagctaaaaataaatcttatttttcggttgatttgacataatttaaaaataagcttaattttataaataattaattttttcaatttctatgaaatagaatgagttggattaattgtgtttgcgattgcgattacgagatttttacaatttttttttatcatataagaagaaaatcaaataaaagaatcattagtgaacatgtcgatgaaacacgaggctgatacgttcaatgtcgcttggacggcagaaaatatcttgaacatagaataatagcagtacagttcatagaaaacgacgaaccggaaattgcttttcgattactacagtatcaatatatagattaatcaatctgcatttttcgatagcatttttagcttagtatatcgataacgtcaaaagtaataatgatacaagatttttaactccaatatcgattgatcgtatcggtatttttataagaataagaaaaatttatttttcattttatttttgtggcataaagtgtataattaaacatgtgttattttccaattgcctgttacttcaagcattcctttcattgcatatttccgaatcatgcacttctctacagctttccacattttaacgatcgacatgacataaattctttctttattcggaaaatattcttcaacaaacgaattgatatcttccgattcttcaacttcttttcgaatccttctaatttcatcttgcaatctttcttccggttctttttttctatcttgtttagcataggaaatattccaaaattcccgaaaaagtaggtcgaaatctcatcgaatttggaaagattgaacagtcagaatttcatgacgagggtatttttgcaatctactgccgatgccattattaacataaaattattgttgaaaagatatcgcatgatttgaagtttgaggaactctctgagaacactcattcatacaattgttattcttcgtatatttattgatttcttatctgaaaattctttttttattattttgatacgaccgtttacatgtggaatgaatgaggtatcgttatttgttgaattgtcgtatttttcaaaaaaaaaaaaaaatcatatcattttaataataataacaaaaaaaaattatgatttatttaatatcatttcctttgtattcacgtagtaatttaactatttctgtatagcctttccaagatgctctaataagtgctgtataaaataatttgaataatttccaattattattttgagatataaaattattaaaataaatattaaacaaaacaattcaatatctttatgatttacatcaattccaagtagaatcaattggagatgcagcattttgtgagtgttctgcattggaatcaatttctattggagaaaatgtaaattttattggtgattacgcattttatcgatgcaatacccttaattgttttaatttttatggtggaacatcaaaataatacatttggtcagttagaaatctttacttcatcagtagaaggatgtacccctccaccaacattaaaatttacagggtcaaatacatattctttaacatctacatttgatccatcatctacgtttaatccgttgatgacatttgatccaacacatacatttcctgcgtaaagtataggggtggaaaaagtccgttcgtcagcttttttttgatttatattgaatattaatgaaatcaaattatataaataaaatttataataaatatattatcattattattataatacttttttccaaataaatatgatgcatgaagtaaataactttttttcaggatacctctgaagaagaacgtttaatcattttaatgtcagttccaattgaggaattacgttctgttgtccatttcctttggttagaatcaaatgaaaatcaagacatatatagacgattatgtgctgtatatggtgataatattattacacttcgaacagttcagaaattaacaaaaaagatgatgaatgaacataccttttcaattttcgaacagaaaaaaacagggagaccaagaagatcagatttagatcaaagaataaccagttttatattaggttatccatatgcatcgacgaagaaaattgcgaagaatgtaggcgcagatccaaaaacagtgaaaaatataatgattaatattttagggatgaaaaaagttaacttcaaatggatcccacataagtagactccagaaattaaagccaaaagagctgccattgcttctgaattatttgaattcctttctagttcaaatgactacagactaagacacatattgacgcaagatgaaacctggatttattttgttaacgggagaaactcgatgtggaatgaatctggagtgcacaaaccatacaaacccaaacaaactattgcctccaaaaaagtaatgatatctgttatatggtctataactggtatcaaatcaataacaatgctcccgataggccaaaaatttaatcgaatttttttttctgagattgtacttggagatttggcaaaaagaatttcaacgaagggatattttttgcatatggataacgcccggcctcatttggttcatgaaaaattgaatgaattgggaattaaaagacttccgcaaccttcgttttcgccagacctcgcaccttctgacttttttctgtttggatatctaaaaaaaatgctcgaaggtgagaagtttgaaaatgaagatcgactttttcaaaaagttgaaacattactgtataatatttataaagacaccttcagagccgtatataatgaatggatgaacagacttttaattacaattgaaactcaaggtgaatacatatcataataaataaacaaaatttcttttacttttttattcatttaaaaaaaggctgacgaacgcactttttccaccacttatacattcacttcttcagatgcttttactcctgctcaattgtcatcacataatatttctgatggtgttactataagtcaaagttattcccaaacattaatttatgttatgacagttacacaaacaataatttcgtattcatatttaactaattcagatacaatttcttttagcgttaccatatacatacattttgtttcattatttgtattttatgattataaagttattacatacaccacattctatagttattattcagatttctttactgttttttatttaaatgataattatgatttaaataataataaaatttcattagaattattaattggaatcatttgtggttcaattgttataattttaataattattggtactcttggttgtgttgttaaacatgctaaagataaaagttcgtcatcgattttatatgaatatgaaaaaactcaagaggacaaaagtaaaatgaataatgctacgaatgaagagccggaaacaataaccggtttttctggtgtacaaacttcacatatcgaagaagatccgtttggaacagatttcttagataaaggattcgttaaaatataatttttattgaattagcatttgtaggtaatgcaatttttaatttttaataaatatcatgacaaaatttaattttttcttattagatgaaaaacctaaagaaaaaaattctaattaagttgtaaatattcaatgatttgtaaatgttatttatatttgctaacagatgatttataccttaacaataaaatgaaaattttaatgaatttacaatgaagattttttaagttaaaaccaaccaattaaatttatatatgttgaattttaatgattatgtttacactttataagtacctgaacaaatttgtaaaagatgaaaatattattgagagttaaaaatatataatcatctttatttatacttgcagtaaagagtcatgtactcttgagccttttgcttgaatgcagtagtgtttgtagaatattgttccgcagcttctttatataatggagaattagaatttggcaaaaaacaaaaattgtgggcctaaaattagttgatcaattgatagccttacccttcaaacaccacttttttatatgcgaaaatcttctccaatgattggagaaacatcgtttaaattgtgtgaaaatttatcaaatgttacgattgttgccaacactttttttgttggagtttttcttataatacactttatatattccaaattattaaaacatattataaattattaaaatgaatatatgttgcattaatatcaatacctttttgttctaaaatatgtttcacacgttcgacattatctgattctgaagtaatggcataatatttttttggaatttgatttttttgaaggaaatttataacaaattataatttccatttcttgctgattagcttatattatcagcattaatattaattttttttctttcaaaaacgctgaaatttcatcactattaatctcatatattaaactcgacttgcaatttccacccatcgtatatagcgatcatcctacgatcttgatattatgaatatataatatatatacataattacaaatttgattaatataaatctgaaaataatatcataattagcacgagataaatttattctcattttaaaaagtgacaataatcgacttttgcatggttaatatcaaacgatagcaacaacgataagagacgataggagcaaatttgaatgatggtaaatattatcaaaattttacccttacctcgagaagatacgttattaatttacatcattgtaatttgtcaacagccaaattaaataattcttgtgttgttaagaaacaaaaatattatatttttttcattaaatcgttatttgtaattgcgctcacaattttcaatattgtttttaagttttttttatgaatcatatttaaaatgtcattgatggagcaattacttgctgaagctgatacaatatcagccgcaaatgtttcagcaggaacgaaaagtacatatgataggctgattcatgcttatgccaaagtgatgagaaatctaatacacgaagaaccatttcctattactcatgacaaattggttgcattcatttatatttaaaaagaatcagaatatgaaatgttgtacgttactagcttacattaatagttttgcacattattttcagtagacatgagcagagctggtatggaaatttcagatacactttctatataaacaataaaatttttgcaattttaaattgaattgaaaattgtgaacgaaattattttttttaattttttcatttcaaaaagtggctcgatgagaatttaatataatatttggaaattatttatattatttcaaacagcacttatgtttgcatctttaaatggtcatacagaaatagttaaattgcttcttgaacaagagaatattgatattgatgctaaaaatatttttttgttttatttaaaatattttataaaaatatgaaatttcatatgaaacatttggaattacttataaacatataaaacagcgcttatgatatcatcagaagagaaaaatgcagaaattattcgattatttgcagacaaaattcaacatcataaatgtgacggcataataaaattaaaagattcacaaggataaaagaggaaatatttaaatattgaaataaacatatcctaaattcattttgttttcatatattattattaacgcattaaatttgttgattagaatattttatatcatatttcattgtatgattttcatataatttgatgataatttttgtgaaaaaaatgatgtaaaattcataacaacaaaaaatttattattattcatagtattatttactcttaaagtttaatggaagtctattgagtacaccttattatttttaattccataatacaaaatatttgtatggaatcgtaccagctacccttttaatcattgattttttttttcttctttccgatcagagattttgagtaaaattttatcggaaaccacctaaaaagtgacatttttaacgtgcttatgatcattgatagtccattttttttcactcgactttttgtaaattttacataacgatagaaacgatattgtatagtttatgcttcaaattttttttcgataagtgatacttgtcacaaatcaaatctgattttttgcattttagaaatattttttgtaaattcgagaacgttaatttcactcaaaaagttttatcattcaaagaaaaaaaaacgagttgaaaaaggtatatttttctttaattaaatttcgcctcaactggacgtatcagtttcatatgtatagctatattcataagtttcataagtgtaagatgtatcgaaatccaaatcaaatgattcgcttgcatcttcttcacctgatcctaagcaagtttcgaacttggaagacattgcattcacatgcactgagtccaattgtccacttctgcttaagtttgttccactatttgatcgtatcaatctcaggtgattaattgcttcattcttctgttgtaatgctaatggcatttgcttaggcgatggcagtcttggcattgatagtttccttgttctcttctgtggtgttgtccattcatatttgtaatcatatgtaaacccatatctctcaaaacattgcctgaaaagcctccggtactgtttgtagttgggcttctggctgaaagaaaggtttttgacgaggcggaaatactccaaaaactcatctggaagtccatcgcaaagactttcggcagatgtggcttccttaacacggagaattggcgcgtatttgggatgagaattaccaagaggaagtcccatccagggtaagcggtctttcagaagatatactaatacatatcctaatgattcaagatcgtctcgacgcgattgctcaactccacgaagggcattgacagaagcataacgagctgtgccagtgagcgatttaccgcttgtaaaaggaatatgtgtatgtgtattgggattacaatattgtttggcaagtccaaagtcaatgatgtaaacaaggttggcattgttatcaagccccatgacaaaattatctggctttatgtcacgatgaataaaacattttcgatgaaaatattcaatacaggtaagcatctggtctgcaagcataagaactgttttaaggctaaggcgctggtaaattttcttataatattcgagagattttcctagataatcaaaaactaatgcatggtgtttgttgaaacgaccataccagtgtaattgaccaatacttgaaaatccaaggaatagcttgtatagctttgcttcgaattttagttggggtacttttgtattaacactttcaagtttaacagcatatctttggtgatcttcaagatcctcgcaaatgtatatctccccgaaacttcccgcgcctattctatcgcaaagcttgaagcgttccgccattacttgtccgcgaaggtccatatttgctgtcttgaaattgtgaggtcctgacacccattgaaaatgatttttaattattcaaatttaaaaatatttttgtgcgaaatcaacattcaatttggccgttacacaaaagtcgttctttatcggcgtacttaattaccattgcaattgcaatcaaagaagatcttttttcctgacatggctatatatgaaaacagatgaaggctatgtaattgttatcataatagttactattatgtcaattatagtgtcaaaatatttcatatttaaaataatttttctaaatccaaaatggtgtatgatatatagtaaacacactggtttttacaaatgattttagaagcataaatcgttaattaacatagaaagcacaaaggcaaaaataataaagtctacgattaaattaaattcaatttttgcgtttttatcaaaaaatgggagttgcaatttaaatatcttttccaaaaggattcattttccatggatcatatcccaaattataacttttctcaagaacaaatcaatggcttaatggcgtcttttaatgcaattgacgcagacaaaaacggattcctttctaaacaagaattttcccaatttatgcaagctaaccaacttgacccatattttgtggaagccatttttagaattttcgacaaaaataatgatggattacttagcttcgatgaatttcttgaatacattgatgcttgtaacaagtctgctgctgatgctacgtacctctttaaattgatttttgattgtattgatgttgatcatgatggattacttgacgtttacgaaatgattgagtttggaacattaattggtatcccaattacgttgcaacaagctcaacaagatataatggttcttgataccgatatgaatggaaaacttgacttccacgaacttctcaaggcatttggaatttaaactctttggcccatttacttttttttttgttttttgaaagagtgtaaagatttaaagcgcaaagccataccaataatcgtcttatgtacttagatgtgacaatattttacctaatataagaaacattcttccgcaaacttaagcaaccgttattctatgagatcttacaacagagtggttccgactaattattctcacaaaaatgggaagtaaagttaagaattttacttaacgttcattcttgttattttcttttttattgactctggagagcgatcaggaaaatattcaattaatttattgatatcaccaccaaagttgctgtttaaatctttgagttttttttcttctttttttgtccaagcacaatattttcttccagattgatccatttcttgtcttccttgtatattagattgagaagaaaatattggattcaaaaagtggatccttcacattgaaatatataaaccttacaattgaatttgataaattatttaaattttcatcattaaaactgccatcaagttcgataatttttccgaattcattaattctgtgtctagtcactgttttaatgtacattcttttgtgtaacctgatgaagttaacccttttaatgtcattaataaatttacatatagaatcatggtttcgagctttcattcttaaaacattaaaagaatgtttcaaaaaatttgagctaagtctatttaaagtaatgtttccttgttcagattttaaaaatttcaataagctgattatagtgccttttgtatcaatcattaaattataatcataaatataataaaattgtttaaaatacatcaatgcaagtttcagatatttacatctacttttgacagaaatgtgatcgttattgattgaaataataaaaagtgaccatgggagaaaatattaaaaaatttgatcgttgtgagatttgtcgaaagattttattaatgtatttctgccaaatagtttaattggtaaagaatcatgcattttcgtgattttttcgtctgacataataattgattgtaaattgtattcattgcaaaaatcatttttgaattgattgatatctggtgtatattgatttaaattttttaaaaaccaatatctaccttattttaataagtgtaaataatatcaatgatttatttttttcattcaaaacttgttctcttgaaaagttccgatagaaattatcaccatcagcaggatattcaattatactgaaattagtatgattttcaataaaaatttttaattcatctaattttttggtaatatctgtattggctttactacaatttgaaggaattacatgaattaaaatacaaggattcgaatggttgattggctgaggttggaaaacaaatgcagaattcatagaatttttggagttatttataataaattgttcaaatttttgataagagtttcgaattgtattaagttcctcttgggtaacattaaaaatttttaacatacctgaaactgtcccatttttgaaaattttttaaaattttgttacactaacagcatcaacagcaataatggccttttcttttggcatagaattattatatctaaatttctcttcataaattttcaatagatcaggtaatttagattcatttaacaaaagttcattattcaaaatttcagaactaagtattttataaagtgttgaaattgcagaaaggggcatttgctctttgaaaattgaataggacgatggagaataaaaatgaaccattgaacataaaattagtgaacctacagtccaccttctcccttttggactactatatacattttcaacaatttcattaaaatatggtaatatctttggtatgttttttacatgagtttgctttattggacttgttccaatatttgatcttgttcgaatattttgattaacttatatatttcgtataatattaacattattattgactgataaacttgttgaatgtatttttgcgatgtggattcttttgatctgttttgttttttagcttctctttgtttttccatttataaaaagtgacaatatatttatttttcaacaaaaaacacattatttaaattataaataaaataaaattgacccttttttccccttcattttcaaatatgattataattatgatttgattgaaatcatatcaaagttttattagaattcttctgctgagttttgagaaatagttgttagaaaatgcatataaaacatgttttcttttatcaacgattattttccatacaaaaagtttataaccataaaatatttgaatgataaattacggtttttaaaccgtcgtgcaaaatactactttttctcgaaattcaggaggagaaatccataaatatttcaaactaataaaatatagttaatgtaaattcttatatagaatttttaacagaataaaaacagtgagtttttagagtcttgatgatctttcgtcatgtaaatttatataataaatgtactttttctcaaaatcaataatatttattttagaaaaaacctaatagcatacttagcaatattattgtgcatattaatatgtatgaatcatcaaaaaattataaaataatttttcgatcaaatttcgaaatatttaatttatataaatataagtaatatactcgaataatccgaatctagacgaataatttttactataaaaattttttaatattttaagtgtatatacttgaaaaagtaattacaaattttctgaaggtacatctcctaggagtcggaaccactctgtaataactatcgaaagttgtttaaagtgtattcacttgcaaaaaagatatttattattgttaagcttaacgatttttaatgttataaatcacaaaattactttaactttactgataaagtggttgcagaaaggtttcccaaacacttcagtttttgaatataaatccgatgatttttcattcattccattctatcgttgggaacattattttcaaaattcaaagcagtactgcttgatattgttctgaaaatcaattatcgtcaatataattttctatcggccgtccacggatttttgaaaatatcagtataaacaaattgatttatataaatatttacataatacctatggcctaaacttataaattgtgtctaaaaacaaatgcgctttgtcatatgacaaattttccaagatttcaacaccaccgctgctttcgaactgacaccaaaagatatctcttgggtcatattcgattgttcttcttaaaagttttgttattacaccgattgcatgattaaaaagcttgaaatcatcaagctcaaacattgcaacgagagattcaataaaattataatcaattgttccaattattatttccattgaacaatttctgattatgtctgacattatctttacagccaaagatttgttttgaaatgaaccactttcactaatttctttaattactccaaagaaattaaattctaataattcatcaatcattttatctttgatgatattatcacatgtttgtaatgcagtttgtgatatttctttatcttcacataaacataatgaaactataattccataatcaatttcaatccgatgagaacaaaattcaaaaaatgaattaaaacaagataatgcattccctacaattttcagatcgggcccatgaagaagacaattaagtatttctgcaaactcttgtgtaatcataacaaagtatgaagtgttcaaatcacaaattatgttgtaaagaatttcaatactatcggcccatagaaaaatcagaagtttatcggaaagtatctgtctggagtaaatcaaaagattttttatatcttcttcagtaagatctgtttcagacaaactgaccaaaatcttagtggcttcagatctaatagaatctgcatatgtgtcttcttgtgtgatttgaaagaagatttccatgcaatttggttgaagtaattgcctacatacttctttagaatggattgtgagaagtattattatgcggagagataagaaaactgtttgttcatcatcaaaatctattgaacccattaaagagactaaaaatccatcttttaataaggggactaataattgtggtttgtgataacggaaaacaaaacaaaatagctgcaaaagcttaacgtgaagggttgtatttggaatagttaatgataaacatagtattttggataaattgtactgcataaattctggaaatatatgaaatggctctctctgtgcgagctttcgaagtgctgaaacgatttttgacattgaacatatatctttttgttgataaaaattgaaaaaatttctaaaaagttcttgaatatcaagtgtagaattaggttgttcatcacatgaatcatcagagtttggcatgcctgtttttaaaagtctttcttttctaagtttattgggattgattcctgttctcattttagtaattttaaacgttcataacaatttcaacaagaaaaataaaaccggattagaaaagcatagcaatcttagtacaaatcacgggataaaaagaatgaagttcttatttcggttcgtttttcaagtgaaatgttgttattagataattaattacagagtaaaattatacattattgtgcaaaaaccaaataagtttttcatgtactgtaaaatgtacatatttatttttaagtgtcgaatttttttaccaaatttaatcgaaatcttttttttcttgcaaattcaaataattgatatcaatccttattgtttaggcactcatataataatgttcttcatttatatacctcaattctgttctcataaaaggtagatacttctcaacatagacaaaagagggtttttgccaacaagtgtattccgtttggggtgccctaaatttctaaatcgatttggaaatgaatatacgaggacttcataatttcttaacggaggtagctaccagcacctctgaagcacaagcacacgacagaataaatttagaattatttaaaatcaagaaggcatttatatcaccaaaattatcttcgtatgatcgaaaaaaatatattgcaaaattatgttttattattcttaatggcatagaagttaactttggtcttcaacaagtcatcgaattaattatttccaagaaaacaagtttccaaagaattggatggatggcagctgcaattttttgtggctctaattcagaacacttaaactcaataattccagaaattaagcgccaattaaataataaaaaagatgagtttgcagtatgctttacattatctgcgatatcatcaataggcggtgctgaacttgcagaatctgtaggtccaattattgcagagattgcttttgatcaaaaatactcagaacatgctcgaaaaaaagcattacttacattaacgaatttatatcaaagtacaatgcaactttcttctgtcgatcgtatttctgccaaaattccttcccttcttaaagactccaattatggcattcgtttatgtggttctcatttaatttattccattttacaaattcaaccaaatcttcttgaatccgaaatattctctcttgcacttgaagtccttcaatctttttttaccaaaaatgattattcagccgagtatactttttttaatcttccatttccattattagcatccaaactttttcgaattttatctttccaaaccgattggaatccagctgatttgattacgcttgaagatatcatcatcaaaatcatcgagaagaactcatcatttcttggaagcgaggattcactcgtcactttttacacaattttttcagaggttgttgaaatatcggttagtattgaaatttctgattcaattactcaacaaatcattgaaattttatttcaaaacataaactccaatttccattttcttcaagtttattctcttcaaaagctcgattttttgattgaaattaatccacattattcatgtttagtccaaccatatctttcaaacttatatcaaatgatcaaatgtggtgatcatgaacttgatattttatccataaatttattatatacatgcgcatttaaagaaattggtcttgatattgtatccgagtttttatcatatcttccaaattcgtcaaattatttacatgaatcattatgtataaaatcatcatatttaattttgtcttatgcatttgatgagatttgggccattgacaaattaatttcaattattgattattgtgaagaatcatatttcaacgaaatattaaaaattataaatcaatttatagctcagtgtaaagtattgaattatctgatattcaaattaacgaatttaattttagaaagtaatcaaacaaattttaatgaatttttatttcgtttattatcatatttatatggagaatattgtcatcagattaataataatgacattcaagtcatcacaacaaaaattaaagattcgtttgacaatttttcggaacaatcgaaaggaattattataacatctttgtttaaaatagcattaaataagcccgaatttcaagaagaaacgatttcgttttttcaacaatatttaaattctgattcattcgatatcagtcaacgatgtaaagaatattcgattttgttaaaatatcccgaaacattccaaaccaaaatattaaattcgtcgaaactattaatatcgaataactttgaatttattacgcaaaatgaaattgaagaagaagaagaagacgtcgaacgtgattctgatattatattttattcagagcaactaaagataacttcaaatgttatcatttcgtcaccaaaagcatttgttacattaaagttcgaatcttttgatgagatcgaaataacagaaattaaaattgatacaaatgaaaaccttaaatatgaaattgttgatgttgaattacctatgaaacttgaagaagattcaacaaaaattatacaaatcgaattcattgcattaaatgtttttgttgaatatccaattttacatatcaaatgtgatcaaaataatataattaaagcaaaaattccaatttcgcttctaaaatggtttcaaaaaatcgattttaataaaaaagatttcggcgaaaaatggaataaattatacgaagaagttgtggaccatttggttgttcctgacgatgaagttataccggaaataattagaattgtcggaaatctacttaatgtgtcgccttcgttgatacttaaagagaaaaacgttgtggcgtacgcgttgaaagtggagttttcaagcgatttcgatgtttacgttttggcggtgttcgaatatattgaggaaaatatggatctggtgctgaaattaaggtcaaactcaaaactggaaataaatgaaatgaaaaaatatttcaaaaaagcgttcacagattaataaaatgtttgtaaattgtttctataattatattttctatcctctttttcaagtattctttactttaaaaaaacatttttactgtttctgtattatttcctaataagtgcttattgtttctcaaaaattaaatagtattgtaactaaaggagatgtgaaaaactgtctactttgataagaatgtcattcatagaatctttaatacaacccataaaaaaagtatatatactaagtttaatgaacaaattttaaattatatatatgtatttcactcatataatgcatttttgaagaaactatcatttaagggattttaatttttaacaacttccaatttcgtgtaaatgtgaaaattaagtcttctgtatttttggcaacaaatatcttcaggcacaaggatgttcattgaataattttttcttcattgaataattttttccaagtagttctgcgtttttagttattatctcaataagttttttattattcccaaaacaaacttacaaaagtattttatttccttccgaacatttgattgattgcgttcgcttgcaaactttgaattgaatgggccgatacggagtttcttgatgtttttgtgtatccgagaatttccttcattttggtgatgtagatttgcttaatcttttcatagaagttagcagcctttgcttctatcatttctccaacgttaacaagatgatcaatgtctgttgtggctcttcgattttcttcaaattgatcagcaacagatcctgaaagcgttaaaggttccatatcagtatcaacagttagcgtcacaagagaagaagaaacagcttcgtatcgaaatgtcccatcaatatttggagttacacttaatacatcactactatcaattgtaccagcaatatgcgtataatcacttaattcagaatccatcgacctgtgaataaaaactccaattccaaatgattcttcattgtcaggatcaagatcccaacaatatacagaacatattccagagttatggtaatacctttgcctgtagttttgaaaaactttgtttgccttgatttccatctcgcgaagtcgatctgaaggtaagattccttcgtcaagaggagggaaataaacatttgagtgaggtgaccgatatgaatcacaatctcgattgtaatcacatttaataaattgcttatatgaaatattatcataagctacagaaaatggagtatcaactgttgacaaaagatcatttgctaaatcattatccaacgaaattatattgatcaatctctgctggatatctttaggtggtacatgtctaagtaaatcatgtgcagcatcgacttttgggtacatttcggcaggtgatgagaaaaacggttataacgagaatggagtgccctataaattgaatcaaaccgtcatattcgaacaaagtctttgttttattgttttaatgatccacttctttctcatcttcaacaggcaaggaaaaacacgtctaacaaagtggtacgaaccacaaacaaagaaggataaagataagattacacgcgaagttacaaattcaattttatctcgtccaacaaatttctgtacttttatcgaatggagagatcgtaagcttgtatataatagatacgcaagtttattcttcgttatgtgcgtcgatgtaaatgataatgaatcaatgattcttgacattatccacttctatgtcgaaacccttgactccttcttcggaaatgttcgtgaagtagatatcatttttggcttccattatgcatatatgcttcttgatgaaattatattggcaggtgaatttgttgaaagctcaagaattaacccaattcaatctcttatagatcagagagatgcaatttcttctgaacctggtaaaccattcgaactttaaaaatcatatttatcaaattcccattttttttttttttctttgagttttgcttaaaataatgatgcatgtgatgacatacatatgtgaaataaatttatattttatcatacaaatatgataagttttctcaaggtcaaacaagggcatgttattttatcgttatcttaaaaaagttatgtattaaatagtttacatgatttttaagtattacgatagggcatcatacaaaataggagaaaatgaaaaaaatttagcacacataacttctttattttgattttatcacacatattcagcataattatatattttataaaatgaaatgattatttgactattaatggttttatataaaataatattccaagagatttccaaaaaaataaaaaataaaataaaatcatttctatttgttttgcagtaatagcgattattattatgttttttatgcttttatatgtgaaaaatattactcatttttaagaaatgataatctgctaaaaatcaatcaaaaatatattaaataaatatcctaatttaaaattcgaatttttaatatgttaaatatgattattattcataatgtgaatatatatattaatattatataatttttactggttttcaaaacataattcaataaaaaaattgtccttttattacagaaaaattcacaaactcaacaattgttagatttcccaaatgtttaatttgtttcttttatatataattcaatcttatgaagaatcattttcaggacaaacttttataggtacatttaatcaagggcaaggaaatttacaaattacaaattgcatattccaaaagtttagaactacaatcattactattaataacaatgatctttcaattgatggatgtgaatttagttccaactcaggagaaaattgtattcttcttaaagagtcaacagcagaaattaaaaattccaaattcataaaaaatataatatctgaatcaggtggagctatttattcagaaaactcaaagacaataataacgggtaatgttttctcaagtaatagagcacaaaaaaaaggaggctcactatatttatctaatttttgtggtgttataaatgattgcaaatttgaagggagttattctttaactggatctgaaatatatattgatggaacagttattaaagatgatataaagaactcattgaataatttaaattttgaaaatcctgcatcttgtgaacaagaagaaagttgtttaattagaatggttaatgatataaacttagaaatttctaaattcttatttaaagatatacaatatcaaatgaattatattttttatcttgaaagtgtttcaaataaattaatctttagtgattttaattttgatgattgtagacctggaaattcatttatttatctttccgataagaaaaagattgctaattttaacttaaatcttaaaaattgcatttttaaagataattctcaaagaatatttagttatgatcaatatgctcaaatctctgaaattagttttattaaatgtgtattaaatggacaatcaatatttgatatatattctgtaaaagaattttctttaatagaaacaattttattcaatttcgatattattggaaaagggaatcaagaatgtgaaacacaaaaaattttaatacaaaaatgttcgcttagtaatctttgtactgggaaattaaaaggaattaaatcatctaaattaatcatacagattcatgaaaatatgtttccaaatgcatttttaagattaaattccattaattcagaagaaataaatttcaaaaataatcaaatcgaatcattaaatttaagtcaaataacaacaaattcattaattcttaaagatatgaatttaaattcggaagaaaacaagttcgaagttgagtgtaataagttagtaagtgagaaaaatattattattggaggaaattatacatttatagttatatcagatattatagaatatttgattactgattcgacttttaaatgtgacttaaatataatttctaaattaaaaatgcttactcctcaaaataaaattgatttctgggtaaagaattcaacaatttctcggcatttaacatttttaggatctgtaacctcacaaattattccgaattccaatttttatgttagggattcttcatttttaggatgtaattcattaaaacgtgaagctattgagtttaaatttaaaaatattgatattagagatacaatgtttgaagatactccaataattatatacatagcaaaaaaggcatattttagagattcatcatttttattagtaaatagagatattcatagtgatactatagcatttcattatttgtttggagcagatatatatttttatggatgttgttttaatttttaccaaagtcatggtaattatcatataaatgtcaattcaacagctgttattacttttgatgaaggtaattgtctttatggaaatagaaaattaaatttagaacaaaatgcaatagcaaaatatttaggaaaaaatgaattaagaaattgtgaaaaatgttctctgactctatatgaaaaacaatctatggttaaatcgatagcaattggaattgtaatagctacaaatgttattacagcaggcattattatatttgtttatattagaaaacattatttaagtgattcaggtgaagtattttcaaaagatttcgaaaaatattcaaattataaatcaacaatcgatgcacaaagctcagtaattaatatcggagaaatgacgcaagaaaatccgcttttcacagcaactgaaacattagataatcaaaattatggatttcaacatgattttgatgatagtgacggctttttatgatgtgattgttcctaaatttcaataaaatactcaaaattgtattattatttcattgaataaatatttaaatatttatattatttcatatttaatttaagtaaattacttttgtaatcattaaaatgattaatcattttgtaattgcaattcaattaaaaatgaaaagatttataaatttgctaaatggaattatgattaattacataagttaactatatgacaattatggcatactcatttgaaaaaattcaaagaaaaaatttatgttttatagctttcaagtttttccagttttgatcgaataattacattttcttcttcttttctttcaagtaaataactatattggcgtaattgatcacgtaatcttttgttttcaatttgttgttcttcaattttatatctaagttctttctcagtaataattgacttttgcgcttctatttcataacttgaacgaatttgtttttctttttgttgatattctttttgaattttctcggtttcgtttctgtgtaatgaagaaattttttcaaattcttttttcagaataacaatttgttttgctagtttgtgatattttgctttatagatctttcttttttgtttcaataaattattttcttcttgtaatttatttatttgtgttttcattgttgaaatttcttctgaattgtcaattgactttttcattgaagatatttgatttaataattgtgtgatttcgttggcattgtcattttgtaatgtttgaatttgttgttgaagttcttcaatgcgttgttgacttgaatgttgaagagaaagaaatctttctttattttccatattcaaagcatcaatttcatttttatgatttattgtaacattttttatttgctcttcagctttattaaatctttcgatttgtgatttaagatgttcttcaatagagtctttttcttttttaatcattgacaattgatctttcagagatttcatttctttaagtgaatggtcttgtgattcatatttgagttgattgatttgatcttgaagctttttgtttcgagattctaaatcaactatttgatgcgaatgttcttcttttaatgaattaacttcttgtgataatattttattttctgcttcaagatgatgaatctctctagaatatttctttccatgtttttggaatttctggatttgataagttattattgtaggcacatcttcaatttttgatacccctgggaatcccattttatttatttcttggattatttgggaagtttttttggaattattcttttcattaataagagtttttcgaagttttaaattgatagatagttctgttttaaagtatgaaaataattttttgagaagaacaaaacataaattattttcatctggattttcataattattaataaatgattcgatgtggatcgattgacttagaatttggttttgaatagaatttagactatcatcggaattttcaccttccatggatgagcaattacctgtataacgcataggagaagcattcattcatttttacaagaaccttaacgtcaaatgctaacgtatttttgttatgacacacttccccattttagataaaaacaaaccacaataatattgtaaagaagatacaaataatttgatgaagtttaaaaataatgaaaaaataaagtatataattttgcaaattttattaattttttaaagtttggttaaaaacattcaatttaaaagtcagtgctattcaagtggtataaagattatataatatttatatttacatatgaattaattgatcaacaatgatcaattaaggtaaatacaaagaacgtaatatgaacagatacctaattttcaagagtacaattttccccatattgcaagtaatctttttgttggatttggatacttttggtttgtttgaagaagttcaagtgctctctgtgaaaacgctgaattaacatctgaaatttctggttgtgctgacgggaagacgggatttctcagcggtaaaaatgtcgacattgatgaactacttgtttcataaaattcatttttaggttcttcgctatattcatatgatgaagatgtatcatcatcactttcaagaccacgcatcaaaggtattttattttttgggagatttcgaaaactcatgaatttgaaaaaattttctggtgaccaagacgattattttcctatgaaaaagttatggagaaaaattaaaagaaagattacttgtttcaagcaattcagtgtaattaaaatgcattctttatgttaaaaaagaacattttatttaatacttgttttaataaataacaaatagatgtaatttatcataatataaaatttaaatatttctgctgatattgatatattaaacatatattataaattacttaatttttaattatctgaaatacattttttccaattattttaattcataataaagatattacatcaaagtaaatatgggatttaaacttactggcctatcgaagagaatgcattaaatgatttaaatgaattataacacactctcattaataaaaaatttgttatcaataataatcaatttgataaaatcaaattgttttataataacatataaaggtccaaagggggaaaatgattgcttatgaaatagaaacgcatagttattaaatcaatttttattttaattatgaaattccaatttccgctaacaaagaatctaatagactgttttggagcttgaagtcatccggaagctcttgcttgagttcgtctaactcggatgtgtggaatgtgtaaaggatttctgtttcatctgctgctaactttttgcggaaacctgtttctgggttccatttaaacatttctcttacttcgtgtactgcttcttgtaagtggaacatagcagaacgaattcgaacagagagaattgtatatatgtcaggagcttgataaattgaaccatcaacaatatagtacttggcaagcaatgaatcctctccaccttccctttgtattttgtcaattattgcaagacctggacaaataataattgctgaataattcggatcacttaggttttccttctgaagacttagccctcgtggttgctcaacatagctaagtctaaatgaaattccatctgttttgtcaagttgatccattgatctattttgcatttttaaaacttcattaattgatgttgtatcataaaaatcactagttgaaaaatactgaagaacatttgctacagtaaggttttgttcttttagaaactgatcgtttctgaaaaagatgttattcatttcttcttcatcattcatcagcttattgaatttcatatcacatttcatatatggactaaaaattctcaaattcaaaacaaatgcatttgctaaatttaataccaattttttattaaatgtgatgttaattaacatttaacagttcatttctatgtgaagcctcggagaatggtatcatcattttttggaagtcttctgtgcgatgtgaataaactattcaataaataacggtttttcggttatggtcttcctttttgctaatgccagcaaactttgtaccaaaacacaaccgtgaacacgcaaaaggttctttcgatcgtggatgccgctgctgccaacgccgtcgtggtgttattcgtagctatggaattaacatgtgccgccgatgcttccgtgaacgtgcgggtcttcttggttttaagaaatatgactaaacatacacacaagcgaaataaactttagtgggccttcaatattattattatttttttttttttttagtatcagatcaattgtaaatttagtaatcatttaatttctgtattatcattattaaatgtttaatgaattgttttgttttcaaagaattaaaatatattcatgtgccctttgaacttgttttattccatttgcccaaaaaacaggacgaaattttctatagaaaaaagaaaactttacattcgcaagtaaccgcacaggttctcaatggtggaaaaaggcgaattgaaagaaatttcactaaaactaactcttattggtgaacactttgttggtaaaacaagtatgatagaacgttttgtcaatggaactttcgacaaatcttatcaagcaacaattggattcagttttctttccaaaaccatcgaattggatggtgttaaatgcacagttaatgtttgggatacatctggctctgaaagacatcgtgctgttgcaccaaattattaccgtggaactgatggttgtattctggtttacgatgtttctaacccacaaagtgttgaaccactttcttattggtacgaagagtttacttctcttgtatcattgccaaattacgataacatccctattttattaattggtaacaaagctgacttaccatatgaaaaaagtacttatcaagatgcacagtcatttgctgaaacacatcatatcgaaaagcattttcttgcatcggcattagatggaagaaatattaatgaagcattcaatgaattggttaaaatgtgcattggaaaccaaacaattcaatttagctcgatccttatgacaaatgaaccaacggaaaaacgttgctgttaaatatcttatcttgaaattcttaaatttaatatttttgttaaagtgaagacttttgctcttttttgtttttcgattttcttttatttttaggataaattatgattaatcgttttgttcattattaggtataagttaatatattgattctttatggataaacatttgttttattcaggaaactattgaaatgcgtataatgctttttttttttatgggttttagtgtgttgattggaattttttgtttttggataaaaagaacgtttaaaatatcttttctgggttttgggtttttactcaatggaaaaacctgatgaaaatttaattgatgccccaatttctaaacaagaactcaaacagatttttattgcaaagtcacaagattctaattgcgaattctcaaaaaaaagttttattcgatatcagaatcatcataaaaaagaaacaaaacataaaacatttcaatttgacggattaggtattggtcctcaaactattaaagtaatatcaaagataattttaacacattcaaacttcaaagttattgttctccccaataattcacttggagatgaaggcgcaattgaaatatcaaaaattcttcaacaaaatcattcaattatatcattagacatttcatcgaataaaatcagagattctggaatgtcacatatatttaaatctctaattgataataagactcttattcatcttgacattagtagcacgaatacatctacacgaaattcgataggtgttgaagcatctaattcattaagttctatgctttttcacaacacagttctctctgaagtgaatcttctatgacagatctttcatctgatcatgcctccattctcagtcatggactttcgcacaacaaaaactcttcgatttctaaatctttccaacaataatcttacatccaaaggcgtaaattttattcttttccagtcttatcggcacaggcattgtcagtcttgatctttctaataatcattttcgtgatgacacatctccatattttattaattttttgactaataataatataatcgaagaacttaatatatcgaacaatgaaataacgcaacgatttactacatcgcttgttccacaacttgcatccaataaatccatacgtaatttcaatatatcacgtaacgctttatatggaagaggaatctctgctattggatctgctttaagttataataacacaatcgaaacattaaacgtttgtagttgtttaattgatacgaatggaataaatgatttcttaagagaatttttccctaataaaacattgaaatcattacttttagctaataatcctttgcatgatgagggtataattgaaattgcgaaatcgattgttcaacatccgaatcttaaatatattgatgttgaactttgtgaatttggtgataaaggtgcgaaagaattgtttgaagcgattgggaagtcaaaacaattccaaaaaatatctgttaaaaacaatctaattcaaaatggaatgatgatcgaaaaagcgctttgtgataattctaattttatttcatgtttatttgactttaataacattaattataaatgtgtaaaagaaattcaaaaacgaatttcatataatttgcaaaaatataacacaaatgaaaagaagaaacaaattcaagaaattgaaaacattgaaaagaaagaaaaaaaattaactgaaattaataaatatattaaagaagaacgaaaaaacatcgaaattctgcaagaagaacttgaaacgaagaaaaaccaaaatgaaaatgttcaagaaaacaaatttcaacatttaaaagaacttgagatgaaacaagaagatttgaataacaaatgttttgcgtttaatgaagaagcgaattcaaaaacggatcaaattgaaaatgaatttgaaacgaaagaaagtgaacattcgataatttccaaagaacttttggaaacgtctaaaaatttaagtactgttatgaaacaattagctaacattgaatcacaaattaacaatgaaaagatgaaaacatttaatgaacttgaaaatcttaaaacacaaatcaaaatatcgaaaattaattacaatgaaaagaaagaagaactaaaagaaatatttcaaaacattaaaactgaaattgaaacaaaagaaaatgaaaaacgtccaattaaaattcggaaacgaataagaacaaaacgaaaacatatcaaaaatgaaaataaatctgaaacataaaattaaagaaaaacaaatgcggatattattttatttaaaaaataaactttgaaaaagtatttttcataacaaggaattattaaaaggaatattagggaaaatgtaaaatgaaagtgaataaaatgattcacatattgcaactaatatattatatctaaagtaaaagttttcaaaagaagttataaacaaatcacatattattcgaaaactataacaaaatattttcatttcttgtgagtgttaccacatataaaaaattaaataaaataaagattatcatgtttttattaatattattctgagtgttcttctttatttttattcatttcaacttgttttaaactttctatcaattgttttgattcaatattgatatacatttctcttttaattcctttcttagttaaatgaatatcactttgataacaaacaaatataatatcaattatattatttaacattccaaatacaaatgaacaaaataaataacttaatataaatatgataaataatgataaaatccaatcatgaataaaatcttttattataaatttaatatataaaaagaagaaaaatgtattaattcctgatgtaacaatttttaaagaaaatatgataaaatttgtaatcccatttaaagatattgttaataaaatatcattaaataatatttttgatgaaattttaatacttttataccatgaactattataaatttgtgatattgtaaaaaggattcgattaatataacgaagaaatttttcaaaaatataaagacaacatgttaaacatttcattaaaattataataaatttactaatatttaatgaattctttttaattctttgttcaataaaatttaatattataattaataaataaaaaggaataataattatagttgaatatgtaatagttccaagtgatttagtaaaagataaataaaatccataaaaacatttaaaattacatatatttgaaatattttgattaaaataccaataaacaatagatgaagagattgaataaaaattaataaaatataaatgaatcgtgataaatataaaataacagaaattatatattaatatatatttaataatatcattaaataaataacttaaatataatttattatttttatatttaataataaaatcatttgatgtataattaaaaattgaagataaaaataattattaaataaaaaattaatattaatattaatgaaataaaaggtataaaaaatgaaattatatttgaaatagttgcacgtgatgaaatttcaataattttaatagttttattaagtttatctattaaaaatactataattaataatataataattccaatacaccaaaatatataaggaatatatttataataatatttattattattattatcattattatcattattatcattataaatataaaataatattccaaaacatataaatattaaaggaaacataaaacatataaaataaataaagaaatttgtaaaatattttaataaatatataaataagaatgatataataattgataaaaatgaagataataaaattggtaaccataatttaataaatgaaattatattttgatttaaacctggaataaaatttataaaatgatttttaatactttcattaagaattggaatacaacgatttaatatttgttgtgtaggataagggcaaatacatttacctcctttcttacgttcttgaatacgttgttcttgattaaaatatgaaggacaaattcgaatcgaatctttacatgaatctgtgatcgcttcttcaaaagtatttaatgttggacattttttaacacaatattgatgttcaccgattctttcatattctttcccattatttcgtggtaaactaaataataaataaggatattcaagaaaattataaagttgaaatctcgttgaattataattatgaattttattaattaatttatgattatcaatcccacaataattcccattttcatcccatgattgaaataataacaaaggtttcccttttaaaattccaaatattaataataatattaataatataaaaaatataagaaatattatactaccaaaaatatcatgaaaattcatattataaatatcacctggatttcgatattgaccccaatttcttcgatcaattttctctttacctgttggaagtataatatcactcatgttcgattttattttattttaattattccttcttatgtttgaataacgaaaaaattcatttatgaaaactttttaattttattttttgttactaatgaaaaattgttattgttaatatttgaattaaaacattgttttgggtttttgtttttatttctatccgtttctttttcaaaatgattaacattaacgaaaataaacattaaaatcatagttatttttatgattttagtaatgttatttaatttagagattaaagttccaataaactcattggaaaaaaatgttaagttatatataaaacctttcccaagatgattctgtataatatgttcgtttttgctttctgtttcttttattttaattatacatttaacaaatagaaatgtaagtaacaaaaattaatgttttgcttttttcaacttaaatgaaattaaattacattggaatgaaatgcacaatttacaaaatttccttgaaacaaattactctgatttttgcaatataaatatttaaaattaactgtacaatttcataataaaataaacacttatatgattccgaaagttttacttttatgtaaatttcattcacataatttatagtaacatgaaatgaatcatcaaaattatacatttttcatcttattcaaacaacaaattatttatgaaaaatttatttattccatacaaacgctaccaaacttcttcatcctccgaattgacgaaattttccaaatccaatgggtaatactgtgacacgtcccatttatctattagataagcaataaagtttatacccaaatctgctatttgttttccataaatcaaaatttcttttgactgtacaatatttggtccgaaaacaattgccaaatttttcttatccatttttgtgactttttcattttttgccatttgttgtaagaaaccaaccaaatatcccaaagtgacgacatgtaattttgggagtgttttcacaaacgaaatatattccttatctttcagcttcattagtttcgatactaatgtatatggtattaaaggttcagctaagtctcggacccaactcttaagtaatgacgcgatgtcatcgactttatcattaaggaatgattcgacgccttcgtttgctctgcaaatcatttggtcgacttctttcccacttcctgtgatacggaatattccgacatgactttcgcagtttaattcgagtaacttcttgatcatttcgtatagcactaatgggattggacaattcggatcgatcttacgttggttccacatgatttcatataatgacacgccgaatactttacgtgacgtgtatacatgtaaaggaatctctgtaatgttttgaagtaacattccgtcgagttgtttcccaatgctacaacgctctgtgaatcgaatgtacgtaaactttacagtggcggagattttcgggtcgggataattcattcgttgcgacaaaaacgatttaatccatgtctcactatttaatgtcgatggaaatatcgtagcaatgataagaaacaaattatatgtcgcaattaaacagtcttggctcgtgtttccttgcgtttgcttcattatttggaagtatacttcatcaatcaatggcgccttcgagtataatatcgatactaattcacatgctgctgataaattacttttaccatttgcgcctgtgtaacttagtattaagttaaagcatcgaatcgcatcgcgtttatacatttcaggtaatgattgcaaaagaggagctgttaatggcttcgtttggaatgtgatcaaattgtctaatgaaaccttagtacgacggaaaactcgacgctctttttgcttctggaaatgctgctgagcaaaatcgcggaaaacaaatttgtggatttcatctgtaaatgacaccggaggaaggcgctctttgcgcttgccagtcttctcgggaggcttcggtggctttggcgcggcgcattgttcaggaggaacaaagtttttgatcttgggatcgacttcgatgacgacgtttttgtactcttgatcagaaattggtggcggaggaggcggaggaggaacagcattagcattggcgttgtcggctgtttgcattagttctgtttccgtttgtttttgtggtatcgaattagtttcgctttggttttgcgatggttttgttgaggtattcgatgttaaaactttgggttgttgactttgattggatgaagaataaagtgactgtgaatgatttgcattcggtggtggtgatgaagatgaaaaactttgaggttttaacgaaggagtaactgttgttgagtgtggttgttgactaatgttagttgatgaggataatgttggtggttgattttgtaatgggattggtgaaatggattggggtgaaagtgattgtgaaagtgatggagttggctcattggatactggttgttggtcacgagatggagctgagttattggtagattgttgaaataattgttgaaatcgaggattatttcgctgtgatggtggaatataatgtaattgtggatgtggtcgcttaacggattgagatggaggctggggttgtgatggctgtgatggttgaggtggaagattagtttgtattatgggatttgcttgcggagatagtgattcaaaaggacttggttctgtagcagacccaacaggtgatttagaatttgacacttcatttggatttggaaatggtttacgggtgtgaggatctagaacaattgcattttctggatatttccatgttgttgttccgagggctgcatcaaggtaatagtacctttgctttttttgatcaaagtatgcatagtacccctttttatcattttgcatgtaattatgatgttaacgtattccaacactttttatataacgctttggttttgtatgagcttttttaatgcagtacgttatggatgaaactttttgtgatgttaccggcttttttctatcacaacaaaaatacaacaaagataaaacaaaaagaaatattattattatttcatatttcattaatttgaatataatatttgaatttaatgatagatatataattattaaatcgtggtcaggtaaagagatatgaataatcacttattaaaaatctcccatataatgtttctattaagtatgcggaaatatatgcagattaattaattagttctgttaaataaaaatatttttattgagcggttgtttgtttctgacacattcatttttggcaggtggtttgattaagcttttgttaggatttcaaggctttatattattctccagtttttacttagaagtgacagtggcaagataaacttgcttctcggcgtcgttcaaagaatcaatgaaaatcctatatagtaatatcgtatgttagatatgtttattttttaaactattatcttgtatcatttttattaaaatttttgtgaaaaagtgaaaataaatgtaaaaacatttgcaaatgcaacttttgatatgaagtggcgccgatctttatttatttttgaataagaatatattatataatatttagaaaaataaaataatttttaaaaaatattttttatatgaaaactgatcttgatttatttttgaataatcgagattctggtgaagtgaaggaagccaaataaaaagcgctttttaaacccaattgaatttttctgtgcaaaaaatataaagtaccgaattgaacacagttcaagcacaaacttccacgatagaaacgatgtcaaaaattatgtgagtcttggatcaaaatcacatgaaaaagtcattattttcccatcgttctttcttttgtggtttaacaaaaaagtgttatcgtttaggaaatgaaagttgtggattctttgcttcttgttaaatttacagtcggggatctacctattattctaagttcatggccgcgcccttttaattttgtggaagaagaagaacaaatgtttgtgtcctcagcaaatcctttgacagaattaaaagatgggcaagtatattctttcaatataccctccatgtattgctattcactcttttttacgcatgatggaacaggctattcgcttgttcttttatcaccttatccatttgctttttttttcacaacaatattaaattatgtttataatgagtttcaaaaagatgatacccctctagagcccctttcacgtttatcatatcttgccaccataattaaatcaattccagataatattaattcttccattactgttcattttccattttgggattatgagacaaatattactccagattcctttacttacaaagactatgatcccactgattattttacagatgaacaatgtaatgaaatttggttatcattatttaccaacactccaattcttttcattgctgaagacatcactagtgctaacgatgctgtttttagtgcattatctcttctttcaccacttcaattttgtgatgaagtatgcgtttggctaacagaaacagatccacgatttgtctccataattaacggcgacagtaacattaagattgcggccactagttgtgtttatttaggcgaagcgacatcattttttaagaatgtaattcaagttccaaaaagacatccgcgaagcagtgaaattcgtgaagagctccaaaagaagacgaaacaaataataacaatgacgaattatgagctcgatcatatggtattagcaaaagatccatatttcgaagacacaaaacaagaactcgacaagcaaaagctccaaaagtcgcttgactattataagaagtttaatttgccgtgcgcagatgacttcgtaaaatgggaaaattcaaacacgtttaagaagtggagagaaataaggccgtcaaaagatccatttagagaaggactactgaactgtgataggaaacttctgctgcaaaagaaatcaaaagaagaattggaagtcattagtaaagttatcgatgaatatcgcaaaaaatataaaaaagacgaacacgtaatggcggtcttaagaatgcataaaagagaagtaaagaaacttctcaatgaaaagaattaatggaaatgtatgcacttaataaagtttttatacgtttaaattttcatattaataattcaatttctcttgctgaaaagatcaattatacatagtaataataaaatttaatttaataaaattaataaaagcgcatataaaagtgcgtatggtgaatttaaccatatgtgtaaatttcaaaaatagaaataaaatttttaatgctcaataatttcgtcaaaatcaggaattgtatgaaattaatagtgcatttatgtctttccttgcataatttattaaagtttggtatgaaaattataaatttttaatctttaatttttgggttttttggaattttaaaaaatttgttttttcggcggttgtcatcacatcgcattcaaaaagtggagaattgtgggaataaccaacaaaaagtgggtacaaaagaggtacagttagcacacgacccgacaaagttttttttatatcttttggtatatattttgttgtttgcacacaaatgataacgttaatattaaaatgtctgagctttttcaataatcttgacatctccgtctttttacttctcagtaaaggatgattagcaaaatcgtctaatatcaacaagcatctatgcgaataagttttccattgatatttcgctaactattcagaaatgtattttcatttctttttcgagttattcaaattatattgtcataaataatctttctacttcttcatccgttttcttaaaatctaaattgatatatttgatgatagaattatattttaaaattctccgaatatatttattaatccagtctaacaaatcagtatcttttatcgcaacaagtttcgttttctttattgcttttttatatgtatttactgtttaatcaaattttgatgatgtacaacaaatagttattagttcaaaaaacgattcgttaaatagtacttcttgtttcgcgctgagtttaacgtaaagatatgatttaccataacatattggcgctataaatgctgttattccgttctgagcaaataagaattttttatgtattggttttattttcgcgttttctaatatttctttgttttgtttttctaatttatcgaacgattctttaatctcatcaaattttttatctatattcttcgatttatttttccgcattattttttttatttataaaaataaattttttacctttaatagctaaaattattccaagattatttgatatcagaatatataattgattacgccgccgttgagtttaaatataatcacaatacaacagttaagatagataaaccgacaaacaaacctatacttcataataatattcttgttggcgttaaattttatgataagaatataaaactttttgaatcagtaaattcaaagtttaccgataacattcttactaaaacaaatgaaaagaaactcataaatattgcttatgcagaatcaaataatgaatttatgaaagccaagaatgatatcgtataacgaatcatcgatgaattagtcgagaaacgtgaagaaatcgataataaaattatatcattgaatgcatatgttggaaatgaaaatatcgcgatatcaaaagagtttgaaggtttaaaaattagttttccggatagtacagacgacaagaaatcattggatatgtaaattatatagaaataacaaacacattacgaaataaatttatatttaattttaacgtcactttttcaatatacgccttgcgttcgattcccatacgtagcgttttttgtaaatgctatacgttcgatttccaaacctattgaatttcatttttgaacatttttatattctaccttaacgttcacgtcatcctctgtcatgtgctcctgattgttttgaataaaatgtttaacaagatataaatttccaattcttgctgattcgttaacaatatcatcattaatattcataccattttcttgaaggaacaaaaatattttataattaaaagatgtaatacatttctttcctaattccaaatttttaatttcaatgatgaagctgtagctttattcagaggccaattacttccatatgcaaaagagcctgaaattcggattttttatggaaaaataattgcagattttttaagatataaatgggaaggaagtacaggaagggagcaagaggaagttgcagaggaatgcaaagatacatatgaccaagttgtggagctcacaaaaacttcattaccagtttatcattcattgcgacttgaattgttcctcaatttttctgttttcacgtatgaagttttaggtgatccggtggaagctcgtaatttagccataagtactcgttctgatgcagaatctggtcttgatcaattaagtaacgaatctaaagaagaagcaattcatgcaatggagctcctccgtgaaaacatagcacaatgggagcaataaatttataccattctttttgtgcaatgaatatccatggttagaaaaaataaatgatctttgtaaagtcaaaatttgttgataattcaattgaataacatttcagaaggtaaatttgatgtaaacttataaaaaatttgaattggaactcaacttattagattaaaacccagataggattacaaacatgaaattatgcaataatttaaccattttttttttaatttagaaaaaaatttgaaattttatttggttcaaaatgttttttgagtttcagacatgttattagctaaaataaaaatcatgattttctaactggatcaatgacttaccgtatattattagcttatatgcaaagttgggctctgataaaataagagaaaaaattgtttcacgttttgctcaatcccaaattaatgatgctttatggaataggaatatccactgattcagaaactaccaatgttcactacatttatacaggtggtgtcttctacgatcaaaaatcacctgttttcctacatcttttggaaacttaaaaatttttcttctttataaaccattcaataattgtcacaaattttacaacggattcaaccttaatttggggtgccctaagacatgtaaattaatatttttctctgtatgggaggaagtcaaagtcacacaacaacttacaaaggaaaccttcaaatattacaagatctagaaaaaattatatttgatttaaatgaaaataatattgatcaattagttgaatcttcattaaattacatttctttagaatttcaatattcttttctatatatcatttgtcgaattatttattcatattttgtgtcacgtggctatgaaaaattatgtttcaaatatttacaaacaattgaagcaaaatcaagttataagattatcaacattttcacacaattattattataaactgatagtcaagaatcaaattatcttctcgaaaaaatgattgaagacgaaataattgaaccaaaaattatccaaactaagaagaatgcatattttatgcattatttcgcagaaaaagaaaacattaacaagcaaacagaagaacttaaagagaataatattgaactgcataagaaattaattaaggaaggacataatccgaatgaaattgcgaaaataattcggaatgatgaaatagaaaaacttcaagaaatatcatcacaaacaaattttgattttaatcaaacaattgcaccatcactttatgaaagatgttcatttataaataaagaaaatgttacattaattgattatgcagcatttttttcttcagttaaatgttttaaatatttacttatgaatggttcaaaagtagaaaacgcaggtaaatatgcagttgcaggtggaaatgaagaaatcattcatttatgcgaacaaagtcattcaacatttgataaagcatatgaaacagcaattgaacttcatcgaaatgatatctttagatatctttatgaaaataaattagaaaaaattaataaattagaagaattagggaagaaatgtgttttgcatgacaattataatattctttcatttttagaaaaagaaggcatgcaatctgataaacttattcttattaaatcaatcaataatgggaatttatttattttccaatattttctagataaaaaatcaaaaccaataaaattttcagagatttcaactttttctggtaataaagaactgtttaattaccttattaaacataaatatattgacataaaacaaaatgtttgaaaaaaattgtttgaattttattttaataatttaatatttcaaaataatatttggaaattatttaaattatttcaaacagcacttattttagcatctagaaatggtcatacagaaatagttaaattacttcttgaacaagaaggaattgatattaatgctaaagatatttatttgttttatttaaaatttattttaataattttatatttcaaaataatattcggaaattgtttaaattatttcaaacagcacttattttagcatcttcaaaaagtaatacagaaatagttaaaatacttcttgaacaaaaaggaattgatattaatgctaaagatatttatttgctttattttatatttattttaataattttatatttcaaaataatatttggaaattatttaaattatttagtacagcacttatgttagcatcttcgaatggttatacagaagtagttaaattacttcttgaacaagaaggaattgatattaatgataaagatatttatttgctttattttatatttattttaataatttattatttcaaaataatatttggaaattatttaaattattttatacagcacttatgttagcatcttcgaatggtcatacagaaatagttaaattacttctagaacaagagaatattgatattgatgctaaaaatatttatttgctttatttaaaatttattttaataattttatatttcaaaataatatttggaaattgtttaaattatttcaaacagcacttatgttagcatcttcgaatggttatacagaagtagttaaattacttcttgaacaagaaggaattgatattaatgataaagatatttatttgctttattttatatttattttaataatttattatttcaaaataatatttggaaattatttaaattattttatacagcacttatgttagcatcttcgaatggtcatacagaaatagttaaattacttctagaacaagagaatattgatattgatgctaaaaatatttttttgttttatttataatattttgaaaaaatatgacatttcatataaacatttggaattacttataaacatataaaacagcgcttatgatagcatcagaaaagaaaaatgcagaaattattcgattatttgcagacaaaattcaacatcataaatgtgacgacataataaaattaaaagattcacaaggataaaagaggaaatatttaaatattgaaataaacatatcctaaattcatattgttttcatatattattattaatgcattaaatttgataaatcgaatattttatatcatatttcattgtatgattttcatataatttgatgataatttttgtgaaaaaaatgatgaaaaattcataacaacattaattattattcatagaattatttattcttaaagtttaatggaagtctattgagtacaccttattattttcagtcccataatacaaaaacatttgttcttgagtcgaagtacatcgttacgactgcgtcctgtaactcgaaagtccttaaaatcctcaaacacggcaaacttaacaatgtcaacttgttatttaagtcggacactgccaacacgtaatccttatgtgcaataatcatttcgcaccattgtatttttcggactttgaatttccaattcttcaatttttatttaaaatccattccatatgaaaatatttttttaaaattttatttttttaataatttcacaacatatcaatatacaaggcgatgcactaatttttttaacattaaaaatattataatctaatgaataactatattgataagaaccatttaagaaattaaatgatgaaatttgtcgtgatttataaccacaaattaatgcattacttacaataccgatatcaaaatcaataatcgtcgctggatgtgcactaatttggaatttcattgtcgctggttgtgtaaaaattccatttaataatagaataatttcgtgaagcggtaacaaaatcattcgtactcgtaacttttaatgaatttattaatgaatattgtcgttgtgaattaattaatttaatagttaaattattaatatcaatttgaaacatatgaaatgtacaatcattacatgttgatataattaaaatattcttttgtaaatgatatgaaattgtcctttctgaaataccttgaaatcctgttaaacaataactaatatcaaaaaaatattttcatttttattattctttaatattaatttacctaatgatgtaataataattaaaatattattgaatgtcgttcgaagaaatattggcttcgattttatttcaatttgtaatgtcggtgtaaataaagataaaataaaattaatcgtagaaaaattaattttcattggatgtggattcttaaagatttgatttggaatagtaccaaaacttttactaaattgttgatataaaattaacttttctggatcttctattacttgtttagtcatattcgtaggatatgtataaggatgaaatgtattattagctaaaattgcttctttcccattttgtttatatccaaatattaaatcaatccatttaggtaaatttaaacttacataatcactttctaatgctgctcgatgtttctcaatgaaatcatacgcatttttactccatggtggtaatataacatcattaattttacttccatctgatttgattcctaaatcaaaattatctgaattaattaaaaatcgtggggtactataaaattctggtattaattctcgataatctgttaaatctggtgatgtaatagattcccataaatgaggaattgatgaaaaaattcgacttgatttatcaaatttattatcttgcattttaatattaatacttgtaaatggttctaatcgtattaaataatatgatacaaaatatgaattagaataatgaactttatataacaatttgtttttcttcatccatttctgtaattaattccctttaaatgttctaatcgatcttcatttaatgctccaataggtttacttaaatctcgataaacattcggatcatttaaatcaatagtttcactcgtataatcttttaatacccatggaaaaactggatattgtgttaaatcattaaaacttcgtcctgaaaataaattaattatgattaaatatttataataaagtgggatataatagaaacgatacaccccctgatttaaggcgcttatcacaaagaaatttttcttctcaaaaatttttgagaattttttgatcggcataatttgtatgaattgtttcaaattccgataacatacaactttttgtgctgattttacggtttacttccataagaacgaccgttagtttaagcaaaatttataaatgatataatcgaatgatcaaagtcgcaaattatgacattccaattatattttggtcaattaaaagatttctttaagttaaaattgtttgcttattttgtttttgtgcaagcctaatatggaattatattttatagacctataaaaagactgttttcgataattttctgcaataaaagaacggagttcaactaatttaaaatgataaaaaaatatgtgaattttatgaaactttcgttccccttaaatcaaacatacattacaagcattttgacaatcagctttttcatataaaagaagaacgatattgatcgttgcacacaaatttgagagcataaatattgaaaataaccgttaaccattgcgaacagtccgtaaattgaagtgacagatttaacttcactttcatctaatggctgaagacgaagttcaaacattagttatcgataatggttccggtatgtgcaaggctggtttcgctggtgatgaagcaccacgctcagttttcccatccattgttggtcgtccaaagtatgtccaaacaatcgccggtggtcaaaacaaggatacatatgttggtgatgaagcatgcgctaaggcaggtatcctcatccttaagtacccaattgaacacggtatcgttaccaactgggacgagggaaaagatctggcaccacacattctacaacgaattacgtgttgacccagctgaacatccagttcttcttacagaagccccaatgaacccaaaggccaaccgtgaaaagatgatccaactccaattcgaaacattcaacgttccagcattctatgttggtatccaagccgttctttccctttactcctcaggtcgtacaaccggtatcgtttttgatgctggtgatggtgtttcccacacagttccaatctacgaaggctactcccttccacacgccatcatgcgtatcaacctcgccggtcgtgatctcacagcctacctccaaaagatcctcaacgaacgtggttacaccttcacaacatccgccgaaaaggaaattgttcgtgatatcaaggagaagcacgcatatgttgctcttgatttcgacgaagaaatgaacaaggccgccacaacatccgaatgcgacatctcatacacacttccagatggcaacgtcatcaccatcgccaacgagcgcttcaggtgcccagaacttcttttcaagccacacttcaatggcttcgaattcgaaggtattgaccaaaccctcttcaactccatcatggcatgcgatatcgatgtccgtaaggatctctacgctaacattgttctctctggtggtaccacaatgttcgaaggtcttccagagcgtatggagaaggaaatggtccgcctcgcaccaccaacaatgaagatcaaagtcgtcgccccaccagaacgtaagtacgcagtttggatcggtggctccatcctcgcatcactcgctacattcccacaaatggttatcacacgtgacgaatacaacgaagctggtccaggaattgttcaccgcaagtgcttctaaacagtttaatgggattaattttaccttttcatatggttttattccaaaaagtctgaaatagtttgtttttaatttttctctgcttccattactttgtttgaaagttgttaccaatgaatgattcgaaatctataaaatgtgaaatgtttgtttctttgcctagtcgccaacggtgaggcgtttgccattggacacttcatcaaccatactgcataatctgcatttgagaatttgctttcccttttttgattgaatattgttcctgcaccaacaacaacacacagccttggtgcttcaatgatgtcctttgtaagcatacaatgaaaccagtggcactaataacaacaactttcatgaaaatgaaatgcaaaatttgacaaatgaaaaaagttcaggttaaaggatagcctttgatgttgattcgtttgaatgatttataatcgaaaataaactcaataaatgtttaaaaattgttaactgtgttatagaaagcaaatttcaattttttatatttcacaataaaatgtttgaaacctaacacatagttcacaacttgaatgaatctgaacatataatacattaaaaaaaaatattcataatgacatttatttcattacatacattgatcaaatcggctttatgttcctatcaaaagccttagcgccctcaaatatttctgtccagttcgccttgaactgatttgcttttttagctttcctcactttcaatgtttcgtttaccttattaaatgtctgcgagtcgagctctgacaatccctgcaatgtcacaaatgcgtttgtccttatgcactcatcccaatgattctttgcacttttataaacatatttcacaattattgggtatagagttgatgcatgagttttcagtaaaaatgataccttagggttcatcaaaatattaattgctgtctcagcaacatcagaatttaagttcattgtcatcttcgaaatgagcttgaaaactgatgttgccatctgaggcgtcacattaatctcaaagttctcaagaagttcctcaatttcagacaagaaaagtatttgcttttgacgacaggacttgggccagtgcatcaaaagataattaacggttctgtcaagcaaaaatccactttttgtgatgtatcgtaaaatgagttgaacgtattgcgcttggaaagttggataattttcaagcgtatgtatgggaagtatagcgttgtaataatatgtaatgtggctgggatttagtggagaattaaaacctgtcacaacactaacaaaaaattcgagaatctcagtggagcaattaccaattgcaaaatgagcagcaactttatcacgcacaattgaacggagattcatgtatttggtatataaagtatgtaatatatcgcgtacagcaattctttcgcgatcatctggagacgagcaattccgaactaaattatagataaaactacttgatatattggaggaatgacggcagttcaaagaggctaataagcaattataggcaaggctgatgtgtggccatgcagaatccaacattgagtcatgtgcaccaactacattaatagcaggcatctttggtaacgtacgaaataagttgatagataacattttgtgaaattctttcatggactcaagtgaaatatttcggatgagatgtgggattgaaaaacatgatgctagttgctttaacaatgtagccttggttaccttggccttagcatcaatttttggagatgaaaaatcacaaataattgaacattcagtacattttgataaaaatagatttgtatattcttttggtggcacgtcttgaaagttacgactcattttaatgacgacatcacgttctgaatttaaacgacgcaatgttgaaatacttaatgtttgatcaacattaagattcagttctgattttggaacctctctttttgcaagttttcttggttttgaatgatttgttactgcaggtttgtgaattttggggattggtttgtttccaatccttttcctcatttttaaccgtttattgaacccaaacatataaccgtccaacctttgacatcacctttgtttacgagagcgagaagcaggaaaccaagtgaaacaaatcgagcctcaatgcaatccatttaatccaatttgaaaacagctacgtatataatattttaattgattgatcaattaatgaaaacttcccaagtaaacgccatctatgaattttctaatcttggcttattcctaaaatcatggaaagactcacaaactctgatgtttaaacattgtttacacaataagtggtcgataatgccataaaaactcaaaagaaaacggtaactattcaaaaattcaaagtaatattacggtttgtgacatgcaatccaatggaaataaatgagtgtgaatacagcgaagacgatttctgtgatgaatttttcaatgattctcttgaaatggaataccaacaaaaatcaccaataaaagaagcaattgaaaattcattaaacgaagcaaagaacattacaatatcttcatcattatttgctaataaacaaactgatctcacacttaaatccagagtttgcattatagaatggcttgaaagagttgtatataaaatacattttacaaaagaaacattatacaatactgtttatattcttgatcaagtacttacacaaattaatgtaaagacagaagacattcaattgacggctacagtttgcctatggctaatggcaaaaattgtggaaacatctcattttgaacttccaattttttcggcatgtatttgtcaaaaccaatttacagatgatcaatttattcaaaaagaactcgaagtcataaaagcagttaaaggtagatttaattatccaactgctcagttatttttagaaccatttctaatccaaattaatggaacacaatatcagaaatgtgctgaatacttcttagatctttctttaatgatatatgcattcgtagaaattccaccccaaattattacagtgtgtgcaattattggagcaatgggcgaaaattgtccaatccatcagctttgtaaaatatctcaagtagaactttctcctcttgtccaaagagtttttgacagacttgtagaatttgcacatatcatggtcacaaaaaacggcacaatttttaatttcgtattcaccaaagaagaattggtgtcaatgacaaatgatcttgataaatcggcaatatttttagccaaatatataaattaataaatgtttgatatattttcatatcacatgtcatatcatacagattttgtaaagtattgaacacttcttcaatggtcttgaccaaaatccatggaaactcaaacttttgcagatttaggcctctgtcctcaagtttgtgaagcagttgcagatttaggatggaaagttccaacagaaattcaagcatcaacaattccaaaagctcttaaaggggaagatgttgcaggaatggcaaaaacaggaagtggtaaaacaggtgcatatttgcttcctcttatccaccgtatgattgaagcacaaatcccacctaaatatgctgtcatattagcacctacacgtgaactcgttcttcaaatttcagaagtttgtcaaattctttgcaaaaaaatcaaagctactattgttacagcctacggtggcatggatgatgttgaacaaatggcacttcttgcaaaagaaccaaacataataattgccacacctggtcgactctctcaacttcttacagaagcccatggatttaatctttctactgtccacatcattgttgtagatgaagctgatcaaatggcaggtgtatcattttatgatgatatccgtatcatcattcgtagctcatctcaccaacgccaacttcttcttttctcagctaccatgccacagagcgtcgaacgccttgcagaactttcaatcagcgatacgtcatttgttaaacttggctcaaaagaacaacttccaactgtcatcgaagaagagatgattccagtacatgcccaacgtaaggaagcgacgcttgctaccatccttgatgaaaaccgccaattgtccgttgttgttttttgctcgagttgtcgcatggccgaaattctcacagacgcattaaagaatgctggcttcagtgctgggatggcgcatgggaaaatgacgcaaccacagcgtgaagaacaaatatcgatgtttcgtaccggcgaaatacgaattctcgtctcaactaatgttgcagcacgtggaatcgatattccaaacattgatttggttataaactatgatttgcctccaacgccaaaggaatatgtccatagatgcggaagagcaggtagagcaggacgaaaaggcgctgcgctgacatttgtaacacttgaagataaagatgaatatttgaaaatagaaaaattcttaagaaggaaattgaaaccaaaacaagtggacgagaaaaaggtacttaaatgggttttaccatttaggaaagcgaaggatgaagcagtggagaaatataaaattaagagtaggtcaaagaagcaataaattgttatgtttattaaactatattttaaataataaaagttgttaattcccacataagaaaagtaaaccactcaaaaaattcacttttgactccactttttgcgtggatgcacacgttgtaagcaaaagtagcaaaatgaggcctcatgttcttgagattttagtaatgatctgtctcttaatatgcacatccattaaatgctatttaaacatagaagcaatagatgtaacaccaaaaattgatgcaaatacaaataataaattggcaatatttttatttcaaaatcaacagatcttgtttatattacatgaatttggtatcttgtccataatcatctctttagctttattaaattgcaatattttatcgagctacttattcattcttctcagattcatactatcaaaatcacaatttgacatcgccttttctttcacaagcattaacttccttattattgtcttgtcattgcgcctttcaaagcgattaattttaaattatattttgattctcatttcaggcattttaagctcactagcagctaacatttgcattgaatttatccatattgtcttttgttgtttcttttcatttctatttctatggttaaaaaataatcgaattggtagtgatacagcaccagatttaccagctatccttacagttggtatcttcatggtttcgtcaatcacaacgtttattatttgttctctcataaatggtcatcctaattattccacaaaatttttcagcttttcttcaacacttaacgaatttccaattcttcactcaaaggtaactatttcgttgatcccaattctcccatcattaatcaaaactacagaccctacaatacttttactctcattcacatgttttcttgcttcacaacttttcagatttattcctttgtcaacagaaggatttggcaaagaaatatgtgttgttgtttcgagtagactgtacgatgttggatctcttatcttggtaaatagaagtcatcgtacaattatcaattttgtgtcaataacaatttttgtgtttctgttcattgtttgcaagtttttcaatcttgagttttaatgtactgttaaacatttggctgtttgttgtatggataaataaagatttattaacaaaattatttgacttaatttcacaaatattaaaagaactatggagctgagaatcaaaaaggcatatatgaaataattgtctcgtaattatgtaaaactgatatgtatgaattattaattttgcgttataaacttatatgaaattcttaatatgtagcgtacctttgtgaatatttcacatgttgaaacctgtaatgcagatgcaatttctcttttttcagggtgtagattttatttttaaacggccaaaattcatgtcagattctcctcttgatttctcttcaacacctaagtccaaaaaatcattaatggatcaaactttaagttctccattcgttcttgccaaagaatatcaacaacatgttgacgaattagaaagtgaaaattttacattaagaatgcttctaagtaacatggaacttaggttaaatagctttctaaaatcgcacaatattgaagaaagtgttagacaagaattttttgatcaagaaaaattaattgccaaattatcacaagatgaacaaaattcatcaacgatgaacgaagaacttcaagagcagctttccaaggccattgaagaaaatcaaagattacaaaatgaaataaatgaaagagcgaatcatatggttgatgcagtagctgaagcatcagctcagcttgaaaacgaggcggaagcggctctagaaagtacgtctttgcgcgctaagcttgaagttcttgaaaatgattcacaaaataagcaagatatcattaaaaatcttcaattccaaatcacagaactcaatcaaaggatcaacaaactcacacaagagaatgaggatctcaataaaaacaatgcgttgatagaaaatttgcaaaactcattaaaatcattaaatgaagaaaacgcaacactcaagcagaaaaacaaagaactgactgaagagaatcaaaacaacgaaaatttgtccttcattgactttaatgaagttgaacgacttgtacagaatctcgaaaatgcaacagacacgattgacaaattaaaagaagaaaacgaagaattaaaatcgaaaatattaaatcttcaaaacaatgaagaagataatgtatcacttcttgacaaacttgaaaatgcgaataatttattatttgctgaaaggcacgaaaatgaaaatttacataaaacaatttcatcattaattatatgcttcaaagcaaatgacattgatagtgccatttctaattacgaagcattagttaaagagaatgatgaactcaaagcagaaataagtgatcttgaagggaaaaacgaatctgacgaaaaagtacaaaatttaataaaagaaaacaatgaattaaaagagaaagttaataaattagaaaaaatagaaccgaattataaacaaattgtagctgaaataaataatgaattaatttcattacaacaaacgaatgaaaaattagtcaaagaaaataatgaattacaacaaagattaattcaacaaatttcattaagtacatcgaaatatagtaatcaaaaaacatttggtacatttactttatcaagtgatgatgaaaaaactgaagaagatcttttggcatctgaatcaatatcaatacaaaacattaaaggaataagtgacttaaaaacagcaaatcaaaaacttattgaagaaaatgaaatgttgaaaagtaataaaatattaaatgaaaaggaaattaaagaacttcaagataaaaataatcaaattaatgaagaaaataaatcacttaaagaaaaagaaaaacaaatttcaaatgaaatagatgaacttaaaaagaaaaatataaaattattagatgaaaataaattgttaagaagacaaacatcaaaaagtaattcaatgtcaccaaaatttcagccgaatttatcaattgcagaaagagaaaaatttacaaatgaaatcaaaaaattacaaaatcaaaataagaaaattaatgaagaaaatgaagaacttaaaaagaaaaattcggaaaataatgaactcatcgaaagagaaaagaaattaacaaaagaaatcgaaaacatttcgaatcaaaattcggaattaaataagaaaaatgaaactctacaaaatcaaaacatagaaaatacaaaagcgattgaaagcgaaaagaaattaacaaataaattaaagaaagaaaatgaaacacttaaaaaacaaaacaccgaaaatttaacagcaattgaaaatgaaaagaaattaacaaataaattaaaaaaagaaaatgaaacacttaaaaatcaaaacattgaaaatcttaaagcaattgaaaacgagaagaaaataacaaatcaactaaagaaagaaaatgaaacactcaaaaagaagagaataagttcttcaacgattgaaaaagaaagaaaatttgcgaaagaaatggagaatatgacgaagcaaaatcaagaacttaaaaaggaaaacgaaacgcttcaaaagaagaacattgaaaattctgttttaatcgaaaaagagaagaaaactacagaagaattaaagaaagagaatgaagaacttcaaaagaaaaacatcgaaaattcgattgcgcttgaaaaagagaagaaaattactgatgaattaaaaagggaaaacgaaacattacaaaataaaaacattgaaaattttgttgaactcgaaaacggaaagaaaactattgaagaattaaagaaagaaaatgaattacttaagacaaataataataacaatgctttattagtagaaaaagcgaatgatcttcttaaagaaattgatgaattaaacatattaacaaacaataaatcgaacaaaattgaagcacttaaaaaattgaatcaaaaattaacagaaaaaaacaaattacttcaaaaggcattaaaacaatcgaaactaataacattagaaacactttcaacaacttcatctgcaactaaaatgaataccaataaaataaatcgcgaagattcgattagtttgcaagccgaaaacttaaatttaaatgaaaattatattattttacaaaaagaaaatcgcgaacttcgtaatcaaacgcaaatattacttaagaaaatcgaatcacttcaaaatgaaattgaaaaatccaaaacaataatcacagaaaatgaacaattaaagaaagaaaacaaaacattacaatataaacttcaatcgccgaatcataaaacgaatcaactacaacaaaaagctttcgaaacagagaaaatattaaatcaaaagctcaaacaacaaaaacaacaacataaagaaaaaatggaacaattttctaaccaagaaattaaagcacgtaaaatacttatggaaggatttcaacaactatttgagttacttgtttatcaaatcactttattcatcacaaaattttcgaacaaaatcgaaccattaaatatccgaatctttaaattaaaacattcgataatagaactcatccaaaataaatcgcatttcccacttgtttcattacgttcagatattgtcgaattcattaaaactacatccgaaatgatgcaagatttacatgatgcagcaactgcttgtatacatgcaacagcatcgcaaacgaataaacgaaatttatataaattaaatttatcagaagatgaaaaaaacaatataataaatcttcaacacagatataacataaaatataaaaatgatatggaagaaacaaattcgttcataagctttaaagatgtaagtgattatatatcaacatctaatttaaaaggagttttgaaaacccaaaattcaactaaaaataatgaaaatcgagttatgtttagtataaataataatattccgaaaaatttatacgttgaatacgttaaacaattcgaattctttgtgaaatcggttttgaaaatattcaacgaaaatgaactcgcaaaatcgatttcatttaataattgtaatgcttcgttcaagcaaaacttggttttgatattgcagaaaattaaaatgaactacgaaaaattaatcgcgcaatcaaagaaacactcaatgaacccacaaattgttgagctgatatcacagttctctgaaaatgtaaaccaatatgcagaaagactccatagcgaacatatagagttcatagatgcgatcgaaaaagaaaaaactgttgtgaaaattaataaataattgtttgaatttaaatataatatgtttttaaccaaaaatcattttctttgtttcttcaagaaaataaaaattttatattgtataccaaataatacatatataatttgaataactagcaaattaaaagaatacagtgataatcaaatttatccattattaaacttgaagtttgggtgatatttctttactcaagaaaaaaattatatgacatatcaatagtaacttttcccattcgttctgatatttatttattttgctataagatttattcatacgaatcacatgtgttctgtatgcatcgatcaaaaattatatactttacatcaaaagtacttctgatatacacttcaaatggaatatggtttttcgttcccaacgccacaggctactgtagatagagcaaaagctgaaaacgaaaaattaatagaacgtaaaagaagaattttaacagaactttcagcaattgaaaatgggataaatctttatgatatattgaatcctgcacgtgatgctctctcttcctccgtgacagacgctccatgctcagttgaaatgcttactcataaaaaagtttacaaacctaaaaaattaaatatcaaaaatgcaagtgattctattgcagatatcataatgaaaataggccaaaatccatccaaagtgcctgcgtttcatattagagaaccacatccatgcactgaagttgtaaataatgcaaatgttttttttgcacaattacatttcatgcgttcctctcgagcctctctattatcatctcttgcaataattaatcatagtaacaatatgcaacctcctggaaatacacctaatccaaatcaaaaaattgttgaagatcaaactaatcctccaatcacaccaaagaaatcacatccattcttccctgagatcagaggaatacatccacttcttggacacatgaaaaaacaacttggtgaatttccaacatttatcagaaatccaccagatgatgctgaatgtgaagaccttgttatgtcggcaccgcctgattgctttcaaaaacatattttcgaaatttgcggatcatcaagtgatgatgattttgatccagattcacttaaactttgatttaaataattgttaaaccatatataaatgtgtgtgaatgttgttttgttcatttgatgttatttcttttaaagaattttagtgaatatcagattaacgcacgttaaattaagtgatgctaaatcgcttcaatttactttcaagtaaatattattcatgtgcttgaatctaaatatttaatttgagactttattttgttaaaaaactttgaatacatcagaaattttttcaaaataattattttaaaattgatgttgaacaaatgatcatttttttttctccattctgatgaatatttaaatggggcacagaagttggacttttacttcctagttataacattaatataaattatgcataataaaaatgtgataaatacgactcattttaggattgtatacacaaagctcaatttctcataattcggattttttaacatcttcactaagtagaaattttcctagtttattccactaaagacgcatttgtgttttgttaattgattgttattgaagtggaatagcataaaaagtaattgaatgcgatcatgcaacatttatcataatcaagttaaatattttatataagtattgtttaatttttttgcaatagagattttttcgcaaattcaatttggtttccatggaaacccaacgaaaattgaagaaacgataaaactttttgcaaattgctttcattaaaaaccgattgctataaacagcagaaaattgaatgccaaaattcatctcacaaaattctatagtattcatttcattgaaaagtggaggcctcacttattctgtatgtttaattggctgtatgttttaatattaactccagaaacaagaatcaaggaacatttaggcctgttcgtggtgctgatcaaaaacatcagctcaaagaaatttcgcaaatggccacactaggcgctggagatttgaaagaggctgttaagcttccagcaaatcgcacctttgaagagtgggcagcggcacatgtttcagagtttttcaatcagcttaatttacttttctcttcaattattgataattgcacaactgaatcttgccctgaaatgaccgctggtcccgcgtataagtattattggcaagacaatgataagtataagaaaccaactatgatcccagccagagaatatatcgcgaatgttttattgatggtagaaaagtatcttgacgatgagtctgtatttcctagtgatccagcaactccatatcccaaaaacttcagagaaattttagtgaatatattcaaaagaatgttcagaatctatgcacatatttatttccaccaccgtgagcacatacaaagaattggggccgaagctcatttgaacacatgctttagacattttgtaatatttgctaaagagttcaaattaattcctgaagatcaatacgcacctttgaaacaaattatcgataaattttaaacaaaaattatcacagtttatcttgctttgacaaagctatgtcagctcttattttgtgttttcttttcaatgcgccgtttttatcaagtttttcaaattaatgtataaccgttgtttctgtgtagaatttccacattttaaaacttgaataatttttttgaaatttcaaatatgttgaaatagcgaaatctattattcaacacctgaatcttaaatatattgatgttgaactttgtgaatttggtgataaaggtgcgaaagaattgtttgaagcgattgggaagtcaaaacgattccaaaaaatatctgttaaaaacaatctaattcaaaatggaatgatgatcgaaaaagcgctttgtgataattctaattttatttcatgtttatttgactttaataatattaattataaatgtgtaaaagaaattcaaaaacgaatttcatataatttgcaaaaatataacacaaatgaaaagaagaaacaaattcaagaaattgaaaacattgaaaagaaagaaaaaaaattaactgaaattaataaatatattaaagaagaacgaaaaaacatcgaaattctgcaagaagaacttgaaacgaagaaaaatcaaaatgaaaatgttcaagaaaacaaatttcaacatttaaaaataattattttcataatttaatatacaaaactcattttatttaattcaaatctatgttcctaacagcgtctaacaaaggtaacaatttgacaaatttttctgcgctacttccttttgaagccgcggctttaaactcttcgaccaatttctttagttctggtttcgcttctttcacttcgactttcttttcttccccaataatatgcaatgctttgtgtcgtgcctcgaaatcgtctgctactttttgtgcttcgtctgtaatttcttttggaattccgcacatttttgcaacagcgcatccaaatgatgatgaacaagggacattaatcaatcgatataacagcgtaagtgtatcaccgattttatattgcattgatgcgtttcgaaccattggataatctttgaattgttgtgtaaggatatgataatgtgtacaaaacaccaatgggcaacgaatgttttcgatgaattcttcaagaacagctgtagcaatagcaattccatcgaatgtcgatgtaccgcgtccaagttcatcaagaacaacaaatgaatcttctgtcgaattacgcataagtcttcctgtctctgataactcaactgaatatgtcgattgaccagaaaaaagtcgatcgcctgcaccgattcgggtaaatatttggtcgaatattgttaatgttgctgagtcagcaggcaaataacatccgatttgtgctaatattatagcaacacaacacatacgcgcatatgttgacttaccactggtgttagggccagtgacaataatcacgttcttgtcaccaatgtcaatgtcattaggacaacatcgccctggaatacatggatgacgcatttgcttcaccgaaagtaacgaatggccttttgcttcttccgattctttagtaacaaacttaggacgacatgatgttccttcccaacgttgcgatgccattgataaactatataaacaatcaatttctgatatggattctaaaatcgaatcccaaagttcacttttggatgcaaattgatcaataaaacgcttttgacagccgcttcgaagttttagtcgttcgttttctaaattctctaacttactgataagttgattaatttctggagtgcgataacgtttaacacctttagtttgagaaactaatataaatcgatcatcaacactcgacgctactttgttaggtatagatacttgatagcgttcacttaattgatgaacaaattcaatgtctttacatcgtaattcacgtcgaattttttgtaattgttcattaagttcatcttcaactgttttaatctgttgatcaatttcatcaatatcttcaaatattcctggcttaactacaaattcattactttctgtggacttcttgagatcaagtgattcaatatatgtttcgatttgtttatgcgctgctttacctttcccaactggaagtaataatgtaagttgtgacgtatgaactttatcttcatatgctgttaagatatccgacgccttaattaatgaatttaaacattctaaaaatatcttaacactacatcgattcgaataaacgcgtgtgagaattcgttctaaatcgggtaatatttgaagtgacttcggtaatgtcgaaaatttcggatccataagttcttcaacactatcaaggcgttgttcaatcgatttaatattacgcaacggatgcataatccaaaagcgtaaacgacgtttcccaaatggtgtcgaacatcgatcaagaatcgttaaaaggcaatgttcgtctttgccaatgatttgaagatttgataatgcgcttgaatcaagtgaaagataacgtgttccgcccgcttcattaagtgatgaaaatcgttgaagtgataaaagagacttcgcgattttgtgttccgttaaatacaaaacacatcctccaaatgctgcaattgcttctttcggaaattcttgtaatttctcgggaatgttatcccacgacgcaactttttggatctcattcatcgcaagttgtccatcccaccattgaactccacttttcgcatgtgcgcatgaattaccgcaaagttttttaacaatgtcgagatgttccggacaaatcgtttctttgtcataaataacttcaactggttcaaatcgtattaataaatccgaaagatcttcttcactaactataccgagatgaaatgatccaatcgaacaatcaactaaacaaataccagcaatattacgtccaaacgagcgaagtgacattaaatatgatggctgtgtactttcaagcatttcaaaatcatcaatagttccaatgctatatatttgaacaagttctcgtttgatcgctttttgtcctttccgattcttttgatcaattgctgtttccatttgttcaactttacatactcgtttaccattgttaataagtttaatggcccattcactaaacgctttgtctggaactccgcacattggttctttacctcgtgatgtaagtttaagttttaagacatctcgagcaaaaattgcatcaacactaaacatttcatagaatttgcccttccgtatcataacgatggcatcaaaattatgttctttaatttcccaaaattgtttttgaaatggagtaaaactatctcgcgccttgggaggaatataaacagtggtaggatcataatcaggatcacttggccgtcgcttattggcatcacggagattcgttgtaagccaatctggaagttcaacttcatcttccgctgtaatacgaagattttccatggacgatgatggtgaaataagtggcgactttgaatcactcttagaaggttgtgctttgggcgttttaggtgctgaaataaatgttgaattgggcgtttttgctttctcagctgctttattgctctttttgattttcttggcggtaacaactttatcaaattctttctcatcttcatcttcaagttcatctgacaaaaaatcttgatcaagttcaaagtcaagatcgtcatttgcaattttagaaacacgtttaagtgttcttatagcattagctttcttggcaactggtgatgtagaaggtgttgtgcttttctttggcgaaaagaattgaaataaagatgattgcatgttgtttttgccttaccaaattttgaagcccgccatttgagaggagttggtacttatcggcatttttttgcgggaaagtgaactcattccaaaaattaataaacgtacattgctcaaataaaaaaagtcgtgggaggtgaaaccgaaaatagatgtatgaattaagctatatattgaatgcataaatacatgtggaaaatctgatggacaatatcaaaaagggaagattcttactcttcattaacttaagttaaaatggtaacctgctttcttaattatttttacaatctcatattcgatgcacaacaattgaaatattttattcaaagatatttcaccctaaatataattttgtgtttattattgatatttatttttgcattttatcaatccctgtatatccattttcaaatgcttcaataagtaccgttttaaataattttcaaacaaaacacatattattctagatcatatgcaatacataatatatgataattattttttattaccaaattttcgaaaactattttttttaacaagatattttcattttttgtgagtgtcaccacctataaaaaattaaataaaataaagattatcatgtttttattaaactcgatccttatgacaaatgaaccaacggaaaaacgttgctgttaaatatcttatcttgaaattcttaaatttaatatttttgttaaagtgaagacttttgctcttttttgtttttcgattttcttttatttttaggataaattatgattaatcgttttattcattattaggtataagtcaatacattgattctttatggataaatatttgttttattcaggaaactattgaaatgcgtataatgctttttttttatgggttttagtgtgtttattggaattttttgtttttggataaaaagaacgtttaaaatatctttttgggtttttactcaatggaaaaacctgatgaaaatttaattgatgccccaatttctaaacaagaactcaaacaaatttttattgcaaagtcacaagattctaattgcgaattctcaaaaagtttttattctgatatcggaatcatcataaaaaagaaacaaaacataaaacatttcaatttgacggattaggtattggtcctcaaactattaaagtaatatcaaagataattttaacacattcaaacttcaaagttattgttctccccaataattcacttggagacgaaggtgcgattgaaatatcaaaaattcttcaacaaaatcattcaattatatcattagacatttcatcgaataaaatcagagattttggaatgtcacatatatttaaatctctaattgataataagactcttattcatcttgacattagtagcacgaatacatctacacgaaattcgataggtgttgaagcatctaattcattaagttctatgctttttcacaacacagttctctctgaagtgaatctttctatgacagatcttacatctgatcatgcctcaattctcagtcatggactttcgcacaacaaaactcttcgatttctaaatctttccaacaataatcttacatccaaaggcgtaaattttattctttccagtcttatcggcacaggcattgtcagtcttgatctttctaataatcattttcgtgatgacacatctccatattttattaattttttgactaataataatataatcgaagaacttaatatatcgaacaatgaaataacgcaacgatttactacatcgcttgttacacaacttgcatccaataaatccatacgtaatttcaatatatcacgtaacgctttatatggaagaggaatctctgctattggatctgctttaagttataataacacaatcgaaacattaaacgtttgtagttgtttaattgatacgaatggaataaatgatttcttaagagaatttttccctaataaaacattgaaatcattacttttagctaataatcctttgcatgatgagggtataattgaaattgcgaaatctattattcaacatccgaatcttaaatatattgatgttgaactttgtgaatttggcgataaaggtgcgaaagaattgtttgaagcgattgggaagtcaaaacgattccaaaaaatatctgttaaaaacaatctaattcaaaatggaatgatgatcgaaaaagcgctttgtgataattctaattttatttcatgtttatttgactttaataatattaattataaatgtgtaaaagaaattcaaaaacgaatttcatataatttgcaaaaatataacacaaatgaaaagaagaaacaaattcaagaaattgaaaacattgaaaagaaagaaaaaaaattaactgaaattaataaatatattaaagaagaacgaaaaaacatcgaaattctgcaagaagaacttgaaacgaagaaaaatcaaaatgaaaatgttcaagaaaacaaatttcaacatttaaaagaacttgagatgaaacaagaagatttgaataacaaatgttttgcgtttaatgaagaagcgaattcaaaaactgataaaattgaaaatgaatttgaaactaaagaaagtgaaaattcgataatttccaaagaacttttggaaacatctaaaaatttaagtactgttatgaaacaattagctaacattgaatcacaaattaacaatgaaaagatgaaaacatttaatgaacttgaaaatcttaaaacacaaatcaaaatatcgaaaattaattacaatgaaaagaaagaagaactaaaagaaatatttcaaaacattaaaactgaaattgaaacaaaagaaaatgaaaaacgtccaattaaaattcggaaacgaataagaacaaaacgaaaacatatcaaaaatgaaaataaatctgaaacataaaattaaagaaaaacaaatgcggatattattttatttaattaaataaactttgaaaaagtattttttttttttcataacaatgaattattaaaaggaatattagggaaaatgtaaaatgaaagtgaataaaatgattcacatattgcaactaatatattatatctaaagtaaaagctttcaaaagaagttataaacaaatcacatattattcgaaaactatttttttttttttaacaaaatattttcatttcttgtgagtgttaccacctataaaaaattaaataaaataaagattatcatgtttttattaatattattctgaatgttcttctttatttttattcatttcaacttgttttaaactttctatcaattgttttgattcaatattgatatacatttctcttttaattcctttcttagttaaatgaatatcactttgataacaaacaaatataatatcaattatattatttaacattccaaatacaaatgaacaaaataaataacttaatataaatatgataaataatgataaaatccaatcatgaataaaatcttttattataaatttaatataaaaaaagaagagaaaaatgtattaattcctgatgtaacaatttttaaagaaaatatgataaaatttgtaatcccatttaaagatattgttaataaaatatcattaaataatatttttgatgaaattttaatacttttataccatgaactattataaatttgtgatattgtaaaaaggattcgattaatataacgaagaaatttttcaaaaatataaagacaacatgttaaacatttcattaaaattataataaatttactaatatttaatgaattctttttaattctttgttcaataaaatttaatattataattaataaataaaaaggaataataattatagttgaatatgtaatagttccaagtgatttagtaaaagataaataaaatccataaaaacatttaaaattacatatatttgaaatatttttgattaaaataccaataaacaatagatgaagagattgaataaaaaaattaataaaaatataaatgaatcgtgataaatataaaataacagaaattatatattaatatatatttaataatatcattaaataaataacttaaatataatttattatttttatatttaataataaaatcatttgatgtataattaaaaattgaagataaaataattattaaataaaaaattaatattaatattaatgaaataaaaggtataaaaaatgaaattatatttgaaatagttgcacgtgatgaaatttcaataattttaatagttttattaagtttatctattaaaaatactataattaataatataataattccaatacaccaaaatatataaggaatatatttataataatatttattattattattatcattattatcattataaatataaaataatattccaaaacatataaatattaaaggaaacataaaacatataaaataaataaagaaatttgtaaaatattttaataaatatataaataagaatgatataataattgataaaaatgaagataataaaattggtaaccataatttaataaatgaaattatattttgatttaaacctggaataaaaatttataaaatgatttttttaatactttcattaagaattggaatacaacgatttaatatttgttgtgtaggataagggcaaatacattttacctcctttcttacgttcttgaatacgttgttcttgattaaaaatatgaaggacaaattcgaatcgaatctttacatgaatctgtgatcgcttcttcaaaagtatttaatgttggacattttttaacacaatattgatgttcaccgattctttcatattctttcccattatttcgtggtaaactaaataataaataaggatattcaagaaaattataaagttgaaatctcgttgaattataattatgaattttattaattaatttataattatcaatcccacaataattcccattttcatcccatgattgaaataataacaaaggtttcccttttaaaattccaaatattaataataatattaataatataaaaaatataagaaatattatactaccaaaaatatcatgaaaattcatattataaatatcacctggatttcgatattgaccccaatttcttcgatcaattttctctttacctgttggaagtataatatcactcatgttcgattttattttattttaattatttcttattatgtttgaataacgaaaaaattcatttatgaaaactttttaattttattttttgttactaatgaaaaattgttattgttaatatttgaattaaaacattgttttgggtttttgtttttatttctatccgtttctttttcaaaatgattaacattaacgaaaataaacattaaaattatagttatttttatgattttagtaatgttatttaatttagagattaaagttccaataaactcatcggaaaaaatgttaagatatatataaaacctttcccaagatgattctgtataatatgttggtttttgcttttcgtttctttcattttattatttgaaatgaataattattgtgacaattttttttacatcatataatcaatatgtttatctgaaaaatggcgcatttaacaaatcgaaatgtaagttataaaagtccatattcactctcttatataaacttctttttacaataaaacaattttatgaataatttgccaacttttttaatcgttttaataaaaatgtttttggatattttaagtgtacatgctagaaaaagtgattacaaaatttctgaaggacgattctgctagcaactttaaatgaaagttatatttgaggtgccctgtaacgatagcgatggaaaacgttaattagagtctgaaccaccctgacataaccacttgtaaatgggattgaagaacaacatttggccgatcaaaaaacattgaaatcaaatttttgtagatttttatgattacatataaagcgtgggatgtcaccaaacaaaaacaacgaaatttacgtacatttcttccttctgcatcagaacaaaaccatcatattcgacgacatgttttgggatcttttcaagatttagttatttatcttgaaaaatgtattcacactcatctaagagaacaaaagcctctaaggtattcttttgtctcagatccattagtttcaacacttgaagatattgggaaatatcttcaaaaatttttagaacaacaaacgattccatttgaattgaatgaatttcctcttcgaaacatttttggtatttctatttcacccgaatttaatgaagaacaacggtctaccgcacttgatactctttctatatattcactttttccaaattctaatttagatttatttcttgatgaaaaatttctaaacactcttgagatttatatttgttcaggcgagaatgaaaaacttatttattcaacatttaatttcattgggattatgcaatatttaagtattgaatatcgcaagaaatttaattttaaatttattgaagattttttacatcatactaaaagtacagaagggcgtttttcaaaaagtttaatttttgcacttcaatcatcacttttatttagtgaaaccaacaataataacatcgatgcacttattgaatcatttattaagcatcatttggatgttgttttttattcatttcaaattattacttattgccaacaacgcataaacataactcctaattttagaatattatttcaacaactttttatcatctctgatattgtaattgatgagaaacaaatgaatattatatataaagtactaaatatatttaccgatttacctcaagaatatccgagcatattattcaaaattttaatttataatcaatacccaaaagttcgatattctatttataaattatttcagcaatttaaagaacaatttcaaaatgaaattggtattgaacaaatgaatacatttattaaccaattagagattgaaccattttttaatggcgtacaatgtattaaatgtttaactatgtatcagaatccaggtaaagattttgatttcgataaagaacttttccaaatttatgttcaatatctttcaagtgatttcaacgtgaaaagttattgtttgatgggaattttggatattttacattattattataaagaaaacaatgatgttgacgagtttcaagaatatttcgaggaaattttaagagaaatacacgaaatcatcgatgacgatgcaataagtgaagaaacgcttttgtataaattgagtcaaaattttgaacttttcgttgtaatatatggttacgtgaaaagtgcgatcgacaaaatcgatatgttagttaattaataaaattcgtacagtttgacttttttcttcttgaatggatgtaaattaaataattgcatattaacgtttctttgaagcaaattcaaactcactctgtatcttgacaacagaagttatttagagatatcgtatttccagggcataacggtcgtttccattgaattattgtatagtttatactttcaaattctttaattttttttcgataagtgactttttacgccaaatgaaattaaattaataaaattgaatacaataagtgccgttttgcatcatataaagttaaattaattaaattgagcgcagtaattgccgtttagcattgatcaaaattgaataaaaaaattgaatttcagaaatgttatcttgctcgaatttgtatctaaaattgaaagaattttattattgtctcaatcataaacatgtgaactttttcgtgttatcaaaattcaatattaatatatgaatgcagcaaaaaattgtatatgaatacagatgaaatagaatataatgaaaataatgttgaatattaattcgtatcattaaaaatatgtatgaatcgtataataagtattttttttttgaatttattatatattatttatgaaatacataacatatgtgatatcacatgatcataaaatgtatcttatatgaaaaaaaaattaagattaacaatttcgttgtcgaataaatagtaatttttataaaaaatgaatataaaatagttattcatcaaataaatgtatatatatcagtatatatattaataaattgaaagattaactatatgtaattataatatataatattatcacattggtattcgttaacttatatagcaaataagaaatccatataattatcacattagcaaatatcaacatctacatttctgatattattttaatttttaatatagttgtgtgaacaacaccaaactactatctattatcgtgtgaacaatatcaaaaaataaataaatgatggtgtaaattatatttttttatcagtgaataaaataaagtaaatgaattattgattagctttcgatatgatatatgctaatatcagtatcataataatatattaatactattatatatattattatcattatatatattattactattatatatattattactattatatatattattactattatatatattattactattatatatattattactattatatatattattactaatatatatatattaaaactattatattatattatatatagtataaatactacgtagtagtgtacgtacaatacattagaaattcgtattatgttcttttattcattatataaaaaaccaaatatcaatatctacataatagatgagaaactttatttatggatcctttatttaatatgtatatttatttttagtacattatattaaccttatatgttgttaaagtccagagttgtgacaaatatttatattcattaaattagaacgttattttagaataaaatcaaaagacgtttattaatattaatgaagaagaaaccatccactcaaacattaataatggatagggtcatggaagcatttgtcgaatgcacagaaatgaacaacaaaatagtgagcatcccatcagaagaaactttaaatgataaccattttgattcttatgctctattaagcatttcagacaaaataaattacgaattaaaaagtttaggacttacaaatccatcgcccaaaaatgacgaatgctatgaaacaccatccaatttcattaactatttaaataacttgaaaggaagaaacatcactgaatttaatgatttaaagacaacaataaaagatgaatcaatcaataatatttgcccattttcatgtagcgattcgaacttatataagaaaaatgtcaatgtatattatatgaaattcgtatgcaggtttcatacaaagaaattatatgaatgtcctgcgacttttacaataaaaatacgaaaaaatataattttttcgattaattatgaaaatctttatcattgtcatagtctcgataatcttttcgtagaaagcaagtttacccttttaacttcaaatcaaaaagaaaaaatgaaaaaagaagcaagaattggaatgctaacaaatctcattagccgttttaatgcacccaatgtattgcctggacaattgtataatattattagaaatgataaaaataaacaattcgaaaatgaaattgaaaacctttatcaatatacacaaaaatgtaagggagaatatgacattatttggaaaaatgataataataataaatttgatagtctattaatgataaattcgagaataaaatacttttcttatgcaagagatattgttgtaataaataatgatactgaatgcaccaatagatttcattatccctttttatattttcatgtatccgatgagaataacaaagttcaaatgcttgctatatcaatcatgacatcgaaagaagaaataagtttcactgaagtcatgaatttattaaaattagttattacttctattagaatctttattgttgatagattaatcgctcaaatagaggcaatcaaataagtatattcgaatccaattctggtttattgtcgaattcatatttctagaaatattgaacataaaatgggtaggaattcaatgatcaaagatttgttctgtaaatttgtcgataaaaatataactgaagatgaatatataaacaaattacaaaatttaattcaattccatcattcaacgttatttcagcggccaagtgatggatatattttccaagttgatttattgatttaatttggaaaaattttaagactctcgagaaggaataaaatatcaaaaattgagaagaaattcttattcataaaaaaagttatatgcaaaaaacaaattgcttaataaaaaaaaattttgtacaaatattaattattgatttgaaataaagtacattagttcacaaatatagccaccaaaatttcaaaaataatattaaaaaaccattgtgttttaactttctataatatctgataattatgaattttttatttttgcccgaaactttggcaatggaaaggattatagatgaaaaatatattttagaataaatataagtgttgatttccattagaaaaaggaaacataaatattatcgttatttcaaagggaaaaatattaataaattggaaagctttcaaggttaaattatttataataatgagggaaattgtttgttaagttttcacatttggatgatctcataatttggagatatttaagaaaggatgataatatcgttgtataaataccaaaagaatgcacagctgatataagagattcaaataattgttttgcgatatcaattttggcggggataatattattggcgggttttccaattttcggcggggttttaccacggattagaccgtttatgacgaccgttatgccctggaaatacgattcctctaaaatattcgttaggggcaccctgcacggcaccatttttttatggttttgtccaaaataaaaaacactagttatttgcaaaaaataaagaattttcatataaaaatttgttttcataattttcgctaatgaatacctatattttagttcatttgctgaagaatatttgttctctaaatggaacctcattaaggatcacttttgatagaaagacaaaacaagggtacgagagacgttaagaaatgaattaaatctatttaacgaaaaatttgttgttttccttattttcaaatcatatatattactaactacattattattcatcagttatactatataaagaaatactttctttttcgacgtgacttttatagcatgatgcagaaaatccattcctgtttttactgttcatgtttttgtcgttctacatacttctaaatatattttctttaacattaatattgttgtaatttatgcttaccataaacttgtgtgtgtgctcggatcagtgtaagcgaaaaaaagattccacaaaaatgaatcttatccttgataaaatgaagccaatttttttaatatgttatataacatccccaacaattattggcaacacgcacaacatatgactagtaatacactcatatttacaaacatcaacaacattcgtttcaatgacaccttgccacatctccactttttgaatcaaatatgaatgtcttttaaagtggaagaacattttcacttatataattttatagatattcatccttattgtcgacattgccatccccctctgaaaaaatctcaaaaagtcctccaaatacattcaaaattatgtgaaattgaaattcatcttttaaatcgtgtgaaaaccggaaaaattagttcgcttcattatgtttgtttttcttttttgtttgaaacttttggatgtgcaaccaacacaaatcaaaacattcaatggtaaaacaattaaatttgattctataaatcaaaatgtacaatcaaatagtaatacatgggcatatgtactcatcccagcaaatattgattttattcaattagcaaaccatagtattgatattcgtaaaacgaatggaatgttatatcaaaatgtttataaattatatttgacctcagatcaaatctcttatcttttaagcattaatgcaaaaattagtattcttcaaccaaaagataaaatacttaatcttactcaaatagaaaaatctgataatttaattcttcatggtgtttttgatcaatcattttcatgtttatcttctgataatattatttttaaatcacatcaaattgttatcatctctgttaaagatccattaaaatcagctgaattctatagtcaaattcctgaagttgaatttattaatcaatataatcctccaacaacattaaatagcatttcgagtggttttactcaaaaaataagttcaacagttacagctgatgttcatggtaatccagttatttctcgatattttgaatctagaggtatcacaggtaaaaatcaaacaattgcatatatggatacaagttttgattattatcatactatgttttatgatccaaatgtaccaattaaatttcgtcaaataattccaaatcatcggaaaattttatatgttgaaaacttttatcaaacagaacaagaattttataaatttgctcatgagaatgatcatggaacagaagtttcaggaattcttgcgggcaaagctttaaaccctaatagtaaaatatcttcatataatggtatagcaccagatgctaaacttatttatcttggtcattatttaccaaaatataatcgactccttaaagacatagatctttttttatatactctttcattaggaaatcctcatgtattttctaattcatgggggtttttaccttatgaatcgacaatggattataatatgtttattgatgaagttgtttataattcttcaataggagagaattgtttagttttatttggtgctggtaatgatggtcatgggaaatattttacaattagaaatcctggaggagcaaaaaacgtgcttacaataggtggagcatcaaaagtttttgattatagtaatctcgaaatatatgctatagatggtgaagaaaagtttcaaatgtattttaaagatgaacaaccaaattatcagatagttatgaatttggatgaattttatttatcagaaatcaccgatttaaaacaaccaaatggaacaaagaaattatattattttaattcttctgcatttcctatactaaatgactcgtttttatttgaatcctatttttaccaaataattctaaactctcaacaaaagtcggaaaaaatcttaaaattcaatataaatatggatatattggaaaagatgtttcaaaaattacaaaagcaggttattcatcaattggaccaacatttgttggtttaataaaacctgatataattgcatcaagttcatttattacttctgctttaaataatcgaacagttgataaagatcatggatcaaatgatgaagattataaaaagcatttgtgtctagattcaggtacatcgtttgcaacaccttctgcagctggagcagcaactttaatttcacaatattttgaagatggatattatttagatgaaaaaattaatgtaaattcacttttattgaaatcaattttaattgcttcggcttcacgaaatgatttaagttctacacctgattgttttattggtcatggattaattgatatatcaacagtaattccatttaataatagtaattttggattaaggttttctagtgtcacaaaaatgataaatggtcaaacacatcatatcggaaaaattaaagttacaaatcaaaatgtatcacttcgaattgtattatgttcacatgatattcctcttagttcagacacattccttccaatttattatgatttagatttaatagtaatatcaccttcgaataaaatttatgttggaaataatcgaacacaaaacacagaacattttacattaaatgaaaaagttataatccatcaatcacaattagaaattggagaatatcaaattcatgtaatcacaaatatagatataaaagaaaatttagacgtaccttatataataacagcagttggtccatttgcacaaaatgatattgatacaaatccaaaatttattgaaatgataaatacaaatgaatgtataacatctgaaaatggaaaatgtgaaaatggaaaattaaaatgtaattctggatttacaggacaattttgtaatatccaattccaagaaattccattttattcacaatatcaaatatcaaatattccagcaaacgcaattaaatatttcaaagtttcaccacaaaatgaatatgaaaatttaattattactatatatagttatcaaccgaataatattttttcacttatttgggaaatggattcaaatgataaatatattccttcattagcaagaattactatgagtgttccaacattcgattttttgatagtatctaaaaaattagttgttaattctaaacaagaacattatttaatgatttctaataattaccctgttgctgatgattttttcatatgtttaactaatatgccaatggatggaccactttatttatgtaatgataataattgttctaaagacatatgtaatattacgaatgtttattcatcaatgaattcattatatggaatccataattatgttaatgataaaatattttatattgatcaatcagctgaaatttcatcaatgtttttaacaaataaatttaatttagaattacttaataaagaagatacaaaacataatattaagttaaaaggtccatttttaactaatacaaatggttatgatttaactattaaagatttggatcttcaatttgatgatgaaataatacaaacaaaagaaaacataaaattccaaaacttaaatattataaatgtaaacattatatcaaataattataatttattagttgaaaacttaatttgtgattatgaatcatataatgaaacatttatacaaccaaataatgttttaatgaatgatgcaaaagaaccaattccaataataagaattagtaacaattacattgaatttgaacattctaatggtgaaattaagaaaattcatttgctagaaggaatgaatataatatttgaaactaaacgtgataaaaatgttactttaaatattaaaaataatgaaaaagaacaattgatattaccaaataacacaaatattatatttaaattcttaaataaaaatggttataattgtactatggacgaaagtctaaaaaatataattcaaataatctatggatataaaaaaatggattaagaaaaggttcaatcattggaatttccattgctttagttgttgctataattgtaattatatgtttcgtcaaagtaaaaaagaaaaagaatgaacaggacactacaactgtgatttcacaaggattaatcacataaagaataaataaataatttataaaaattttatttgctcaaagagaaatttatgaataaaataatatatttgagatatacaaaataatcttctcaagaactattttccctaatgaaaaaattaagttcttcttacaatttcatgctttatgtacgttatttaaaaggtactttataagattatttaatttcaagtttctttttaattaaaccaactatttctgtgtggtcatttaaagatgctaaattaagtgctgttttaaataatttaaataattttcaaatattattttgaaatataaaattattaaaataaattttaaataaaacaaataaatatttttagcattaatatcaattcctttttgttcaagaagtaatttaactatttctgtataaccttcataagatgctctaataagtgctgtttgaaataatttaaataattttcaaatattattttgaaatataaaattattaaaataaattttaaataaaacaaataaatatctttagcattaatatcaattccttcttgttcaagaagtaatttaactatttctgtatgaccttctgaagatgcgttcataagtgctgtttcaaataatttaaataattttcaaatattattttgaaatatcaaattattataaaaaattttacataaagcaaataaatatctttagcattaatatcaaatcctttttgttcaagaagaacttttgtaacttcagaatgacctttgcgtgttgcccaatgaagtgctgtttcattaattttatataaattccaaaaaaaaaaaataataaacgttaaatcttcatgagaaacatatttaccattaatatcaaatattttttgtgcgatttgccattcaataaatgatacaaattctttttggtgttgaggaagcatctggtttttaatatatttgacatttttatattcggcattttttttcttcaacagttggatcattcgccgatcttaactaactgaatcacatcgaaaattttttcagataaaccacagaatgttagcagcaatgttgttgtgtaagtaacggccatggattttgcgacgtcgctctgaaccaaatctttacaataaatcattaagcctatattcaaacattgtactcagatttgctttattgatgggaaaagattttaaacactttattttatttacaaaatattattaataaactaaaataagttcattctcatttttttaacttttactgatgaattttctatgataaaaaaaaaatacctcatgaagtaccgacacaatgttccatttttttggaatattttcattttattcggtgtctaatatttatatttagaatatcttttaaaagctgatgggcaaaatattttttgagtggtttataatattatcaaaagattctgacaaaaaaaggtgaataattattagtcattttgagtcttgaatttttgattgatgcttttggtttttggcttgcaatataaagaaagtgacagggcgctatagtggttttaagcaaaaaatgctcattattatcattaattttatattaatctagacattatattttttatataatttcctcatgaattatcatataaaataatttcttgaacttttagataaatttaaatgagaaaaaatggtatatgaaatcaatcataaatgatcatctttatctatatcataatcatttatttcaataagaaaattttgatcggactgaaatatggtaaataaatatttcatctataggatcaattacacaaccgtagaccgaacctccaaatcctctcaatcgatttttaaagggtaaattcagaatgatagaatactttgatcatgaatgtgtaaactattctttgatcttacactaatcagtgagtgatatggcttttcgatttcttaattaaaaatatttaatttctatgagtttaaaacaaggttgatgttacgaccaactggccatttatataatcaaaatccgatttatatagtttactttatatgaaatttacagggtatccctaataacagtttatggataattattgtcaaaataagtcaaaccactaaacagcttgatcggactgaaaaaataaatatttttgtataaaaacataagagaaaaaatttattaaccaccaaggaaaaattataagaaatataacaatttccactttaacccttaaataattatatcaccttttatttccagctggaattttaaaattcaatacttttccctgttaaccattcaaaattaacaaataaagtatacaattttttcaataaataaaattaacagtatatttggccgaccacaaacgaaaagtgacggtcaaacaccaaaaatcttttggggtggttttgatcgttttacattgaaaaggctacgcttattgaataaataattggccggatacatgttttaaacgtttgtattttctttaaagaaattactaaatgaatttccacgcaaacattcgtgcaaatgaaggacttgcaacgcaaattgagctttctagcacatcaacaatccaatcattaagatcaagattttatgctatgaccgggtttacacaagaatcaatgaagatcaaagttaatggtgttttagttacagatgaatcattaacacttggtgatcttgcaaaagatgaatccgtaaacatcgatattacaggacaatcagaatttggagatttaaatgatgtatcaactgttaaaaagttcgaaatttctgatgaagattatgataaaagacatggcacaattcgcgaaatgaagcgtaaaatgggtattgctgtcaaaggagaagttccagaaaaagaagaaaaagctccagaaggaattgaagttggacagagatgtgaagttgaaatggctgatcactcacataaccgtggcattgtacgatttgttggcaaaacggatgttgccaaagggtattggattggtgttgaattagatgagccagttggaaagaatgatggttctgttaaaggtcacaggtatttccaatgtgatgaaaaatacggtgtttttgtccgcccaggaaaggttaaagttggtgattacccaccaatcgattgggaggcagagcttgctgatgagctgtaaataaacgttctcgttttaacgtattctcggttatacacgttaatatcatatgtattgccaaccaaatttaccaggttttaccccacataatcttcgcagaacagattttaggagagggcaatatttcacagtttcaaataatggattaactacagcaaagccaccaagacaagagacattacaaaaggaagttcaagaacatagtcgtcatctaacattttctgaaattaaatataaaactggtgaattacaagatcaagaaaattctaatgaatttgttccaacaccaccagcattaaaaagtattgtacttcgtttctatgcttatttcaaagaaaacatagcagaatcacaagaggaagaagaacgtgttcgttatgtaaaaatttatgtatatgttgaagacaattcaataatgattgaagaatctaaagtacgtaattcaggaatggaacaaggtgttctacttcgccgaatgaaagtactcaatcctaatgcagaagtttatggtacaccatacaatttgtcagattttaatgttggtattaatattcaaatatatggaatcacatatcgtatttactcatgtgatgaattcacagagaaatatttcaagtcaattggtcgagaacttggagcatttgaagaaccaccagatgatttgtactctattaaaaggaaacttactgaacgccctacacgagttacacatattaataccgacaaaacacatctacgccaattcttagactttgacggtaaagttcttaggttttatgtggtatgggacgatagcaagtcactttttggcgaaaaacggaaatttattttacactatttccttgttgatgatacgattgaaattcgccaagttttaccacaaaactcaggtcgtgatcctgtatctcaattcctaagcaagaccaaactaaaaaagccaaatagtacagaatattataccgattctgatttatatattggccaaaaaataaatgtttttggccgtgaattccttatatatgacgcagacaaatttaccagagaatttttggataaaaaatatggaaagaaagattggacacaaatcaatgttgatggagaacaaacaaaccaacaaatcacaacacaaatccaaattccaccttataatggatggggaaatgaagaagattcggttggaaattgtttgtcattacatcctaaacaacctacaaaagatattgttaaacttatacaaaagagcaatgatattttaaggttctctgcaagatttaagaaccctcaaatgcaagatcgagatcgaaaatttgtaattgcattttatgaagctgatgatactttagcagtattcgaaacagttcaaagaaattctggatttaagggtgggaaattcttacaaaaaggcaaatataagaatgttaatgctggaaatagatattttcaagcttcagatttctttattggagctgaagttgttattaattattattgttttgtaattgacgccgctgatgaattggctcaagaattaatggaagcagaacctgatagatttccgaaatctgatttgtttgaaataatggcaatgatcaagagatgttatcctgatggaataacaagattaaagcctattttcgaacaattagatactgataaggatggactaatacctgctcaaaacgtaatgaaatatttagaaagtgagtttggtttacagaaacaagaagtgtctacaataatgagaagatatagtaagaatcgttggtttgattacaaagcatttttgttgggtttatgttgaaataaattctatagtttacactttactttttggaattaataaacgatcttttaaagaacctgaaatggattttattactacgtcttctggttatgatatgaacttagagaaacaaatcgaagaaaaagatacagaaataactaaactgaaacaaaaaaatcaagagttagaacaagaaattgaatcattaaaacttaatgatgtggcattattttcaaaggaaattgatgaaattttccaaaaaaataatgaactgaaagcacagaatagtgatttatcaacaaaaattatggaacaaaataaaaagattgaattaatcatagaaactaacaaagagctccatgaaaaactcgaaaaagagaaggcaagtgccgagtcttatattagggatcaagttgaaaatttaaataagcaaatggaccaaaagcaagatgaatatgatgctaaaattaatgaatatgagagaaagatcaaatcccttaatgaaaaattacggaatataatttctcaaaaagactcaatttctaaaatgattgaaattttcatgcaaaaaactgctcaaattactaacactccaattcgtacgtttgatgatatatttttatttattgaagaaatgcaaaataaacaaattccagaaaaatctgttattgataattctgaaacctctgaaataaaaaaacttaagcgcaaaatcagcaaactaaagcaatacaatcaagaaacaaaagcagcaaacaaatctcaacaagaaaaatttaattcattgatttttgatttacaaaaaagcaaagagaattctgaatctacaattaactcacttaaaagtttaattaggaaaatggaaaatgatcaaaaaatcaaagaaacagactatgatttcaagattcaaacgttaacagacatgaataatgaacttcaaaagcaaattaacaatttccaacaacaaaatgatatcaaagataaaacgccaacagaaagtgaattaaatgatcaagaagaaatgcaccaattagctttttccaataataagttaaatataaaagttgctaaccagaaaaaacaaattaaacaactaaaaaatgaacttaaaaaatattcacaaaatgttaaagaagccaaagacaatcaaaagttgagtaaacttaaaatcacacatcttactgaagaaaaatcaaaacttgaaaaggattcaataacagcaaaagtaacaatcgatgagatgaaaaatgacatcgaaatgcttgaagacaattgtaaaagcttaaaagaaaatcttgataaatctcgtaatgaaaatactcaactaaaggaaaaaattaaatctcttgataattctattgcgaactataaagataaaattacatcgcttcaagatgaaaagaatttaaatgaaaacttaattctctctaataaaaatcataatgaagaattagaacaagccaatagaaatcttaaaattaaaatacaagaattagaagataaaatagaaaaagaatcagcaacacataatactaaaccagttgttgaagttattccatcaaatgtttggaattgtacagattttccaaattcgttatcaaagacagtatttgaaattggttcaaataattcgatatctacatcaaataagatcaaacaatctatgaatactatagcaacatacttcaataatataatagaaaagttaaattctacaattaaagaaactgaaacacaatacgccaaaattcttaatgtaatcaaaagtgcaatttatttattaaacggaaattttgatgaacaaaacattacaagtgaatatattgaaagtttaattaaaaacatcgaagatcaatttaatcaaataaagaaagatatgcgtaatcaagaagattcattaaagaaagaaatacttcaaaaagaaaaacaaatttccacgcaaacggaaaaattaaattcgattttatcacattgtaaacattataaatcattaaacaaaaaactaaagaaacatgttgaaagtaaacaacttgaatttaatacaataattcaaaactatgaacatgaaacaaataaacaacgtaagcaactgaatgaagcagaagaaaaacttgatgaacatatatataaagttgctgaacttgaaacattattaaagcataaagaagaaatcatttcgaatctaaaatccgaaaaaactaattcacagccacaaattaaaacattaaattcaataaatgataatgaaaaagataaagaaaaagatcgaatcataaattcattacaaaaatcacttgaagaaataaatattaaatttgaaaatgcaaaacaattcataaaaatacttaaacaacgtaataataaacttgtggatgcattaaataataatgaaaagaaacaattaactgaaatcgaacaaattaaagaaaatcataattacgcaataagaaatatgcaacgcgaaactcaaagcgaaacagaaaaactacgaaacgaaaacttaagaaaagatgaaaacatcgaaaagaataaacaacaaatcgtaattttgcaaacgaaaaatgataatttggaaaaagaaaaaagagaactcgaagaagaaaagaatcaactgatcgataaaatggaaaaaataaagaaaaaagctgaaagagaaaaaaatttcgcagacatgaaaagaaaattggaaatgcacgcggagaaggaaaaaatgaatgatatgatagaaaatgcaaagttcgagtttgaacaaaagaaaaaggcaattatatacttcgctgtggaacatttgaagcaattttatgatccgaaaaatgacatagatgagaaggcgtttaaggaaattatacaaaaggctgaaatgcagctgaaaaaggtgtaaaatttaattgttaaatttattattaaataaaaatttattaactctataaacacatttacatgaaaaaaaaaattcaaagttgttattacttaaatggctctcaaaagaagtatttactatcatgtaaaaaattgattttataagtatatttcaaaatttttatgatattaagattttttcgataaacaatagaaaaaaaaatattaataaatttaacaaaacgtttatataattcaagaataatggttctttgcaaaatcacttaacttaccatattccaaagtcccatttttggctccatcatcagataacacttgtgtacaataagaatcccaatgatgatcagttgaacataacgcagccatataacatgtttcttcgaatggatttgataaatgaaatggagaatacggcactgatatagcagctgagttttcgattaaaggatcactttcataaatgaaagaattattccaatatatattaatcatgtttggctgcttatgatgtttttttaatattgaataatttgcatgtacatattcaggatttaatgcaacattattaaacataattcctctcatattttttacatcgaaagctttaacaaaataagcaggaacgccatgagatattacataatgttttgtatcattaatgatatttttagaataatatacatattgatcaccttcaaattgtgatattgtagttatagcaaaaagatactgtgatattcgaattatatctacaaataaattggaaagaaaataatatattgccctatagaatggtacaattgaagtaataagagaagatgaatgtttacgtgttaaaagttcttctaaattaccaatatcttgaagtgttagattagttccgtatacttcataatattcttgattatcgtttaatataatttctaagttatatggaatttcattaacataatatcttggctcttttggttcttcatgtttttcaataacagttaaattaaacttttctcttgttatatatttaagtgttgcttgaacaacttttggatttacaattatatattttaatgtatttagtgctgatgcttgaattatatctaaacttccaattcgatatgaacaaagtggtggtttctgagttaatatatgaaaatcatttctattatcatattgtttatattctaattgtgatacatttggtgttttataaatttttcgttgaaatattacaattaatacaactgaaataatgagaataataaaaatgataagttttacttttttgatcttatgaattgtcggcattttcgcaaatttttcatcgcagaaaaatggaactgtaaaaaatacaatagctgaaaatggaaatgtgattccaagaaatgcaatattataagaatatctatttaaatcagccattcctctttcatgtaaatcaaaaaatataccaatttgtaataaaaagcaaaagtaggctgcaaatttcttacctaatgcgaacgctatatctttgtgatcatttttacatgaaaaaaaccattcttgatataaattagtttctggactatctaaaaatgttatccattcatctaaattcattaaatctgatggatcataaagctcttgaggaataataaaccatttacactttgttttgttttgttttatattaatttcaaattcactactttcttctaataatgatttatcaattgctgtatattcatattttttattgatattcctataaataaagactttccaagcatgaaaaaaaacttttacgataccaataaaaggaggaatcaaaccgatgaataacaaatatgttgatttgtatataatatcggttgtaaaagaatgtctgataaaatctaaaattataagtactatagcaccaatatgataaagaccaaaaagactgcattgaatgaaaaaattacattttgaaacagaaggatcttgtaaatattcatttgcttttgcaattgctttcgttggacttagttttgaccatatgtttgaaaaaaatgatttaacaatctttattacaatgtatataaataattcaataacaggaccaagaagaataacattaacaatagtaataacaaatttcttaccccatgcttgatttgtatataaactatgcgtcaaacaactcgcactgatatcagaaataagaataacaaatattggtattgttacaatagtaattactatcatcgaaaaatatacagaagtaagtgaaaatataactgttaaacaatataaaatactgcatatcagggtagaaaaagagaagccactgcatacttcttttggcattaactttaaaaaggcaaaatgaagtcaaacggagtggtcatttctttgtaaccaaaaagtgtattcaaaaagtttaaattcacaaaaaatcgaaagtggtcagaaattaattttaaatagtttacaaataaatttttttaataaattaattgaataattcagaattttgccattgaaaatcctattgctttgttttcatttgcactttatatatctactgaatggtttgacaaatgtttaaataatgagattaacataatttatggaatgatttttttgaattatgatcgttaacctacagaaaaaatttactataattatgatgtatctttatgttgaaagtgaatcaattttatcctatatcatatatatgtaatatattatgcttctgttatgaatatttcttatcatttgaatacatgtacatgaaattaaagatttaataaattaacaaattaaaatttatttcgatacacaacaaacatacaataatttcataaaaaaatcaaaacgttatatatattatatttattacacattatttttaaaagtatttttcaatattttctgaaatatcgaagttttttgtgcgcaaatttcttgtattaatttatcattataaaacaacgaaactttatcatctccgttccacaccgcatttgttggtattccatcgaattcgaatcttattgaacttgacaattcgaatttctccttattctttaatattattgctgattcgacccacgtcagcattttctcagcaggggaaataacaataaatcgttttccatttggggaaactgaaacgaatgaaattggttctttcgaaatttcgattttccaaattatcaaagcagtttcagttgacgaaacaattatattaccatagttatcaccgaagacaacaaattttttagcggaagtgaaaaatggaattttttcttcgataattttaaaaattgcgtttaaattaatttgtgaatttttttgtgtcacacttataatatgattaatgaaaaagagaattaaatctcgatcattcggattccattttttaaagagcatttcaatgaaatgtaaatattgtggaattaaaattattttatcgaagaattcgattggtgatattattgcaaaaggtataatttgttgttcatatatataaccatttgatataccattaatcatttcttcgaagaatttgtttatatcattaatataaactcgaaaattttgatatgattcagataataaatcaatgatttcggaattttcgaataaaaaaggaaacaaattttcagaacattttaacccgaattcatttgataacttaaatttcttacaatgaattaatgcaaatggtaatataattctccaatcattaaacaagttttggatgtttttaattatttctaatccttgttcacacgtcaaagaattataatacattttaattaatccgattactatttcacgcattgaatcatttggtgatattaaccaattcgctaacatgaaaatcgatggtgaaacagcttcgattaataacttcgatgtaactgattgtgatataaatgatataattgataatgaattatcattcttcgattcagaaaagcattgtcctgtcgatgatgatattactgcttgaatagctgaaagattcggcgatatcgaaaatgcaatgtttaatgcttcttcatcttctttattatataatggtaatgttaccgtataattatcaccggctatagcatatgtaaatgtatctaatacattaacttgatcacaaatatctaattttccttttcctatatgaaatttccataaaagttttaatggtataaataatggatttgttcgaatcggtaaattatcaaaggaatcaaatgaatcaaaaaaatccatagcatcaaatattaacgcaaatgtttgacaattcggtattattaagtttcgtatttgcgcaaaaactggttctttatattctaatgatgattgttgattatctaaagcaggcgcactcatagcttttttaattgggactttatcgtcaatgtatttcatttttaagatttccttattccgatttatcgatactaactcacctttaatattatacacataaacaaaaggagattcacatttcaaataaaacaaagatttataatatattatatctgttatcggataactaatttcagaaaaaaccattatcgaagttaaatttcgtgtatcaactaatgaaaatgaataatttgcaatgaatattatccattttcttttcgaattatatttcgcttttttgattggctcaaataaatcatgaaattctgccaacttatgattattccatgcaataattgagccatcaatagcaaaagaaaaaaacattttaccatttggtggcgaatataataaatttgcatttttatgtgttccaattggtttattaaaatcatccaaataaacattatcattaatatcaattcgtgcttcatgttttattaagttattatgactactaattgcacatttacaacgatatttagttgtaaaacattttgataaatcacatataatatcattttcatttttagatgaatgaaaatttaatattgacttagaaggcgaataaattataaatccttcactagtgatatatattggatgattcattttaccattaaatgttaatattttttttggtggatttatttttgttaaatcaatttttatcccttctttagttacttgtgatcgaattgttctattagaattaccatcaaatgaataaacattaaaaaatgaacttttggttgtaatcctatcaaaaatattcgtttttgaatattgaatactttccaaatttgggagctcccaaatttctattacaccgccaacggttttgatataaaaagttgtatcgttgacccatcgaccttctgaaaaaaaatcaaattcaaattcaatttctttttgataaagaatttcatcggagtaatatataaaccatttatcaggcgtaacttgaagaatataatcaaggcctggggataaaatagaatcgcaaaaagatgaatcagtatttaagcaatatgagtatgtacaaacaacagaattcccaaaaaatgaaaaaactgaatttgttccatcagcacatgaagcacagtgaagttgtccatggccattaaaaaatgtaataagagaagaaaatccagaaattcgtgaaagaagagttcctgatttgatatctgctatttctattgtgccaattgattgtgaagcaatcattaatgaagtcttggtttgatgcgatgataaaaactcggatccctctgaaaataatttctgatgatttaaaataatggtaaaatcttgaacagatataattgaaagtgttccatctattgacaaagaggcaatggatggatcatataaaagatgtgtataatttgttatggacgttacttttgagtcatgcccaaaaataaagcaaattggtatgacatttaatatttcattattctgtgaatgtatttgatatgcaacaatttgccctgtggttgtgccacaaaaaagtgtggatgaaataagaggatttgaccagatataactttttttgatcaatttatgattaaacttaacagaaaaaaaagtcgaaaaatcgagttgtggacatgtttgatcagtccaagaattaaatgctacagcaagtaaggaaggatattgaaatttttccttgaacttgcccatctcttttgttagggaagcgcttattttgaatactcaacgactgaaaagtaataaactttttaaccttcttttgtaaagtggcataaccgagaaatacacacaatcctttgtaaacagcgcttaatgactgctttacgtgacatatcgtagactgataattcaatgggaaattaaatgcataacaatcgtatccgatcgttatttattgaaataatggctatgtgggatgaaaaaatctgatgcaaaaaggagtaattaataatgatcacaatggtgaacatccgctatggctgaataaatataatctacatattaattggccaagcaaggactacttatttatactacatttgaaagagtcatgaaaaaaaatgttttaaatttttttttgatttttaatatatgaattcatgattcgaattgtcattaattcgataaaaatttttttacagcaatgcaatttacttttttgattaattgatcttatggttttggaatgatcctttcactcagtgtattaaaagtttacagtgtttatgcatttctatattttacattgaattgaatattttccacaaatttattgtcaattgtaaactattcaaaaatcaaaaaaagaatcgttcatttcactttttaattgatgaccaaatgtttatcagaatttttgttttgacttaatccttttcaaaaagtcgaccattttgtattctttacgtaaattaatgcagctcaaattttatcgcacatatcatttcatagtgtgacttagatgaaagaatatactccacacctctggactactgaggaaagagaaatagcatgggcagctgtaacttatgcaagacgtggtttgaaattatcaatttctccatgcattgcaaaatcgtttacttttttacacaaatactttgcaaaaatagatagagagcctgcacatttatatgtattaatggtatcatctgtatttttgtcatgcaaaattgaagatgcttatcgatcgttaccattaatattccaagaaattttcaaaagcattttggaaatccaaaaaatagttggatgggaaaaaataattcaaacatttggaccgagagattataactgtccatttgtaacagatgaagaaaaaatgcaaattgttcattacgagattatgttcctaaacatcgtgaactggaacccagatattgatcttcctttcaaatactttaatgcaacacaaccagtttttcgtgacattgaaaatgataattcagaaaatacagaaaatatttgtaattttgttatgagggatctctgcttaattctgagaaatgaaaattacttaaacatacatccaattgtttcagttgcagcatccatattacatttatatgggcagagacctcttccaaaattaacacaagcatgggtcaacaacataaagaggaattacccagaagaacttgaccttgcacttttagtattgtataaagaatcaaatcggtgtgttccatgtcattcaaaatgaattaattttgactaagtttgtttataaatattgttctttatcattctgattttttttttgatatcattaatcatccaattagataaaatacattaaattcattaactattactttattatgctaagaagattttttttatgcaaaatattttcttcgaaatttgttgataaattatcatactttgttttttatatattattgcctgtaaacaaaagatattaatgagttattaggtttattgctatattaattaacataattaattaaattataagaaaaaagaaaattattggaaaaaaccgttgtttgatgtattttttgatgttcaaattaattttatgagtgtcgataacgcgaatgaacaacatgtgatagtaagtgaaacacttgaaaagggtaaagagttatttcgaagattatggatgaaaagaactgaacttgagcgacagatcgatatggaaagagatcttcaaacgtcattacaatcagcccattttaaagtccaaacgttggatatagatgaaatatcacagttgcaaacatccaaaactcttgaaaatggttcacttcttaagcaaatcaaagaactatctgaacatttaatgaataataatgaaacaacttttttgtctaatgaagaacttgaaatccaaattgaagaattaaagaaagagaatgatgaattaaaacaagaaattgattctcttacagaagaaatcctaaattttgatgataatgaaatccatttattaagagccgaaaaacaacatttagatttattaaaaatgggcgggtaactccgtttataaatcatcaaattgggaaatcttcctttgttttcgtttgttctttgccatttctcttctctttttaaagtaatcaccatcacttaatgaatcactaatttgatctgggtcataatttctatgattttcattttctcttctaatattttctaattctctttctttgcttaatttcctattatgttcatcgaagttttttacttctgcttccctaatacttaagaacacatcttcgagcatttctcgtgcatatgtttcattatctgtaattaagaaattattaaaaatggaacctggcgcattatgaaagaactcaagtccgagataaccaattgatgagaaatgtccaaacgttggatccttttctacactttcattgatcattttcggtgtccaaacgcctttataatttgggttcttaatgattcgtggtgaccattcacctcgataacgtggattacgtatcattggcggtgcccaaacaattgaatcatcccatgattgaggtttgaatgcatctggatctgcaataaattcttcatcaacccaattatcgggtttcttatcattaggatcaatgatccattcatcgtcgtcccaatcattaggtttaatatcatttggatctggtattaaatcagcagatggaatttggaatcgttcttcaagtgttccattatcaacgatttccccatcaattcgtacttcgattgtattattcttacgaatgattaatgtatatgaatgtgtaagatgatctttgatacaattaacatgtcgtgttgtttcatattttttccctttgtgtgtgataataaaatgtgttcttctaaatgttgcgccacaaatatccggtccaaacattatcaaataatccgtctcattagaaaaatgtgttggatcaacatcagatgacaatattttgatgtattggccagagcaatcaacataataaggaaggcgaactgtgtattgaataatcaaatctttatctcttgtgtccattctgtgcgtgagatttgtgtagagaagataattccgtttactgtccattgtctcgagtccgcgttgctttttctcatcgccccagaaacttcctgatgtgacgcgaacacggcctaattgaacgccttttcgtacatgcgttggcttcttccaacgtgtttcccatccagggccgaaacgttcttccagataaactgttgaatgaactgatatcaggaagaaacagaacataataagttttatgtcactttgcgccatatatttttgaatgagaaaataattcattattgaaaagtgacaaataattttttttcataattttttttttacttatttcttttcataatatgttttttatttggtcgcaaaatgtttgtttctgaatgtagttttgtttgagtataaaacgaaaagtgattttagaaaattaaattttaataattttatccgaatttggaaatttttatatttttctgatgacttaaaaaaatagtgtataataatatatgtttaagtattcctttgagtgtattttaatgggtcatttgaaagttggccaaacaaagtctgtcaatcataaatcctaatgtctggatcaattgattcacaaaatggatcaacaatggttgcaatgattggagatcattgtgttgccattgcatcagacaaacgacttggcgcacaaatgcaaacagtatcgataaattgtaagaaaatatttcaaataaatgattcaatatttattggtttaagtggtcttatgactgatgccgatacagttcatgagaaacttagacatgaagtaaatcttcttgaattacgtgaagaacgtcctttggatccaaaacgtttcataaatcttgttaagtcacttctttacaaacatcgatttggtccatatttcgttcaaccaattatagctggacttgaaccaggtacaaataatccaattcttgcgacatcagatagtattggtgctatgacagaaccgaatgattttgctgttgcaggaacatcaagtgattcattgtatggtatttgtgaaagtctatggaggccaggaatgaatcctgatgagttatttaaaacaatttcaacatgtttgatatcagctatcgaacgcgatggactcagtggttggggtggaattgtttatattgtaacaccagaacagataattacgaaagaaatcaaaacacgtatggattaaacaattcatttctttggtaataattttatgtttactcaattgagattgtctttaagaaggcaaaaaactttcatcagatctaatctctaagtgattgaacgaataatgaaactgtgaaattgttgttgccaaaaatccatatgcccaaatatcaataatgcattgcactgtatcacatttacatggccttgaaacaaggaaggagagtacgtggtaaaaggactttattttcagatcgaaaaatactttaatagaatttcgttcaaaaagtggaaccgatactgccgatttttttccaccagttaagtaagctgaaattaacggtcaataaacggttaccaatttttgcatagtttacatatttgacgtcaaaatatttttgatcttcttcaatactttatattcgatgtaaactattcaattctcttacattgatatcacttttatgatagaaatacgatagagctttttgaacaaattcagatgctggggcactccacgaattcaaaggtcaataacccatatataagtcgaaagatttcttaaaaccattcctaccggatgtattataaattaatagtcaaacgaaaattggtcaagcattttatctacacactaaatctgattatcttcttttgaccttaataatctaaaaactttattctttttatatttatgtaactgcctttttaaaatgatcataattcttcttctgcttctaataatttaaaaattataaacttgttcaaataattcgacattgagtcaagtcattgaatattttgaattgagaccgttcattaaaaaaaatggtcgaaaaattaattgttgatctttatcaaaatggttgtacgcaccaacaaataactcaaatcctacatgtgtgtagccttagggtatgaagagtaataaatgaatacaatgaaactggtaaaataccattaccagtaaatataaatatataaagaagaggtgctaaaccaaaaattacagaagacaagatgattatctcattaagaagaagacaagataattacctccttaaagaactaaaacgttacatgaaatatattggtaaataaacaaaaacataaaagagattttagaaactatttcgacattaatctcattgtcaattttgacaagaatacaaaaattcatgtcaattttcaatctatcgtaatgtcgaattatttgaaccggtttatattcaaccaagaattgttcttgttttttagcaactttatctatttgtcaatatgtggatttgtcactttgaatctctttaaaattttactcgaagtcgctccatacctatcaaatataccagcaccccacgtcatttgttattatttttgatatactaaatttgttcatttgttaattttggaatttttatctccttactcagtttgtttcaatgtcactttcttgtagatgaccaatgaaattaaatactttacttgattcaaacacgatagataagttaaaaataataacagccacctcaaaatattttgacatattcgactttttgaatcaataaagttttgaaaattggcgatcgtttattgaccgttaatttcagcaacatttggacttacaaatacaatataaatcaatgctttattctgactttttagcgtttgcttggcccaaaaatattttcagattgttaataatattttgtaaataaaataaagtgtttaaaatcttttaccatcaataaagcaaatctgagtacaatgtttgaatataggcttaatgatttatagtatagatttggttcagagcgacgtcgcaaaatccgtggccgttacttacacaacaacattgctgctaacattctgtggtttatctgaaaaaaattttcgatgcgattcagttagttaagatcggcgagtgatccaactgttgaagaaaaaaaatgccaataaaaaatgccgaatataaaaatgtcaaatatattaaaaaccagatgcttcctcaacaccaaaaagaatttgtatcatttattgaatggcaaatcgcacaaaaaatatttgatattaatggtaaatatgtttctcatgaagatttaacgtttaatatttttttttggaatttatataaaattaatgaaacagcacttcattgggcaacacgcaaaggtcattctgaagttacaaaagttcttcttaaacaaaaaggaattgatattaatgctaaagatatttatttattttatttaatgattattttaataatttaatctttcaaaataatatttggaaattatttaaattatttaatacagtacttattatagcatcttcaaatggtcatacagaaatagttaaatcacttcttgaacaagagaatattgatatcgatgctaaaaatatttttttgttttatttaaaatatttttaaaaaatatgacatttcatataaacatttggaattacttataaacatataaaacagcgcttatgatagcatcagaaaagaaaaatgcagaaattattcgattatttgcagacaaaattcaacatcataaatgtgacgacataataaaattaaaagattcacaaggataaaagaggaaatatttaaatattgaaataaacatttcctaaattcattttgttatcatatattattattaatgcattaaatttgataaatcgaatattttatatcatatttcattgtatgattttcatataatttgatgataatttttgtgaaaaaaatgatgaaaaattcataacaacaaaaaattaattattattcatagtattatttattcttaaagtttaatggaagtctattgagtacaccttattattttcagtcccataatacaaaacatttgttcttgagtcgaagtacatcgttacgactgcgtcctgtaactcgaaagtccttaaaatcctcaaacacggcaaacttaacaatgtcaacttgttatttaagtcggacactgccaacacgtaatccttatgtgcaataatcatttcgcaccattgtatttttcggactttgaatttccaattcttcaatttttatttaaatccattccatatgaaaatatttttttaaaaattttatttttttaataatttcacaacatatcaatatacaaggcgatgcactaatttttaacattaaaatattataatctaatgaataactatattgataagaaccatttaagaaattaaatgatgaaatttgtcgtgatttataaccacaaattaatgcattacttacaataccgatatcaaaatcaataatcgtcgctggatgtgcactaatttggaatttcattgtcgctggttgtgtaaaattccatttaataatagaataatttcgtgaagcggtaacaaaatcattcgtactcgtaacttttaatgaatttattaatgaatattgtcgttgtgaattaattaatttaatagttaaattattaatatcaatttgaaacatatgaaatgtacaatcattacatgttgatataattaaaatattcttttttaaatgatatgaaattgtcctttctgaaataccttgaaatcctgttaaacaataactaatatcaaaaaaatattttcatttttattattctttaatattaatttacctaatgatgtaataataattaaaatattattgaatgtcgttcgaagaaatattggcttcgattttatttcaatttgtaatgtcggtgtaaataaagataaaataaaattaatcgtagaaaaaaattaattttcattggatgtggattcttaaagatttgatttggaatagtaccaaaactttttactaaattgttgataaaaaattaacttttctggatcttctattacttgtttagtcatattcgtaggatatgtataaggatgaaatgtattattagctaaaattgcttctttcccattttgtttatatccaaatattaaatcaatccatttaggtaaatttaaacttacataatcactttctaatgctgctcgatgtttctcaatgaaatcatacgcatttttactccatggtggtaatataacatcattaattttacttccatctgatttgattcctaaatcaaaattatctgaattaattaaaaatcgtggggtactataaaattctggtattaattctcgataatctgttaaatctggtgatgtaatagattcccataaatgaggaattgatgaaaaaattcgacttgatttatcaaatttattatcttgcatttttaatattaatacttgtaaatggttctaatcgtattaaataatatgatacaaaatatgaattagaataatgaactttatataaaaatttgttttcttcatccatttctgtaattaattcctttaaatgttctaatcgatcttcatttaatgctccaataggtttacttaaatctcgataaacattcggatcatttaaatcaatagtttcactcgtataatcttttaatacccatggaaaaactggatattgtgttaaatcattaaaacttcgtcctgaaaataaattaattatgattaaatatttataattagaaatttctccattaacccatttttcagtaattttttcttgttctaataatgatgaattcgatgtttgtaaatattttaaattaggtaattttaattttttaagaattttaataactgtttccttaatattttgattcggaaatattattaaataacttttttgtgtagttaaaaaaaattctaaaccacatggaatatgatattgatttctttgtaaaaccatatataaatctttaagtttaatttctattaatcgatgtttaatattattattaatattatctggtgtgaaaaaaacttgattcttattaagataaaatgtaccttgaaatgaattatttaatttaatatgttgtgctggtgaagcaaatgaatatgtatatgtatcttctttagaatcatcaatatttatgtcattttcattattattattattactattattatcttcaatagttgtagtctctgttgaattagttgtccctgaatttaattgtttaaatgattgtaatctttgtaatgcttctgtttgatcacgtgaatcacgtaataatgatgcaatttgatgttgatcaaaatgtttattcggtcgtaatatattatgtctccaatctaaatctaatgtcgatgataatttccaatgttgttctttattaatatgaatatttaatgaataattaatttctaattcttgtaataaatctttatatatctttttggctatattcttgattatgcaaattatataaatgttgttgtttaatggtagaaattaaaaatattattatatttagaaaaaaattgtttttattaaatataagttcattattaaataaattatttatcgtagtacatatttttgtaaagttttgcatcatttgtgtttgtaatggaactgttaaaataaatatcgattgtaaccattcacttgatgtaattccataaatttcaggaataggttcttcaataactttttgtaatgtaagctgagtccatgatgtaaattgtttttgattccctttgaatcagattattttgtgcacgaaggggtcgtttaggtacccaatttttttatcattgaattccgaatcgtcatatgatatttgtatttgggcaaatgtctatcggaacttttcaatcatcaataaagttatcaaaacccgataccatcaaattcgtcaagataattgagtgaatttttctgaacattaacaaaaaagttgcgatgtaaaattgtagagcttttctaaacttttttaggttaaaccgaaaaagtgtttttagaactgcggttttttttcagacaaaatgatgaagaagtcaaattccagaagagaaaccattgatgacatgattaagcattggttcaaaaaggctaagcctaaaaatcttgatttaaagggggttcaaggatttgacacaatttttcccgaaattccagatcaacattattcaaccaaaccattccaggggaaaaaatttgatatttccaccatcaaagaaaagcttagcttaggtttaattcctaatccagcttatttccaacttgcagttcttttagtcaataatcttaatcttcttaaagatgatcctcatgcatttgacccacttattcctacattgttcaagtttcttatagccattagcttatcatttcaaaagatctttcaattagcacttgataatgatgagaatgttaaatcatttagtgatactattgcagcctttcaagtttcttttgcattacctattgaatattccattgaagcctttatcccaatgaagagtgtatatagttttcttacaaccaaaatattccaaaacttaaatttcaagacatattctccaacgatgaaacaatccatacgtaactttactaacatgacagtaaattcattattaaacataggtatcgaaacctttgatgacttttatgaagcgtatcaatacttagttgcatatttaaaatatttttcggctatatcgaaagttcctgatcatacgcaaacagaatttacgatatcatgtaaagctgcgcaagtatttgataagattccacctgattattcagagaaatttaagaatgatattatattaccatttattacatccatctatcgaatggttattgacttagcgacagcagaaaatgttgaaccgaattattttgattatttatcatttttatctgattatttatttaggtattgtatatcagtatgtaaaatcacagatatagtacccgaaaattatttatcacaatgttatattaaagtaattttatggtataataagaattatccatttttaacaaaacaacaacaaaatgaattacctaaaattaacacaattaaatttgatgaaaatgatgaaattaaatatccgaaatttgattggataaagaacaaaacatttgaacgtgtattaacaaatgatttaacttataagcaattagatcaaagcgaagttatatttgttaataagttttcacatcgtttattatctacaacacaaaaacttgctgaaggtgtattaagttcttcggtaccatcgaaagttatacaactttttatgtcatttaaaaatgatattaatgaatcgaatttatcacttttatatacgattttatcatttttaatatattatgaaaaatcaattattaatccattattaacaaaagagaaattttgggaatcgattttccaaacatcagtatttaattcgacaacaaatgatttttatgataaattacgtgcgtcaatattttatttaatgtatttatcattaaaagttgcaaattcaagtgattcatattatatattaaaaacatttttacaattttttaatggaactggtctcgaatttggttatttaatatcgaaattgtataattctttattaactattactaatccacaattttttgaagcaatggtaacattaccatttttagaatttatatataattatcaatataaattacaaagagttcatatcttaacaaatgatgttgaagagaaaagacaaatttctgaaattagacaaaactttttattgggacatttaagtttaaagaataatgttattgcaaattatgtattatcatcatcgaaatatttcattggatttatgtttcatttaatctttgaagaagaaacaacagaaattgttactacgatattaattaattcattctttgttaagaatattgatatccaagaaattacttttgttaatactacacaatatgaaccattctttaattatttcaaagatgttattaatgaatctattaataatcttgaagatgaacgttggattaaattagttgaaaagttattttatatattaaaatctacacaatatcaattaacaatgattgaacaaatagaaaaactgaatgtttttccatttgtaatagaaaaagcacaaacattaattgataaaattggtcaaaattcaattcgaattatccaaaatataattttatggatttctacattaacatttaaatgtttaaagggtcaacgatttatgtattgtaaacctaatcgatattttgatcaattttcaaagttattatcacaattaacatttgatgataatattatagatataattttaagaatagtatttgaaaaagatatatatttaaagtcattaccagatttaattgaaatacaatttccgaaagctttatcatttttacattcttctacatgtcatttaccacaacattcgataattatccaatttatattatctatatgtgaacaatcattttcaaattgtttacatatttgtcaatcgaattttttgattattttattagattatatacgtaattatccagatttatctatctttgaagaaggtaataaaattacttcaattgttaaaacaatggatattattaaaagaacaacatcatttttgtttatgccaaagacatttttaaagtcatttgatttattaaaaccttatcaaggtcatcgagtttggtggacttataatttattaacatgtttccaaaatgtattacataataaatcttcattaccttcatcatttatccattttagtggattaaatacaggaatgaaaactacgaatccattttctacaccaaataaatcatggacattaatgatacgattttatttagataacacaatacgattttatagtaatgaacctcgattattatcattccaaacagctaatgatacaatgattgaaatcatattaaagaataatataatatcatatgaaattcaaacaaataaaaaatccaaaaaaaatgttcatgatataaacttttcatcagattcaggtaaatggtatttctttacattagcatatcataacaatgaatttaagatatttgttgatggacaattacttgataaattatccgcaaataattttagagctgatacaataaaatgtttttatattgcacgaggatttcaaaatggtaattcattaacatgtaatattagtgtaatctatttatttaatcaatttatcaaacctaatttacaaaaagatataactaatttaccattagattatttttattcatttatatcatctaatagtaaattattcccatcattacctaatacattattttccaaagaaaatgatttagaaaattctttagttttattatataattcaagaatgacacaaaataatatctgtttaaattattctcaaaaatttaagaatccagcattagttgaaggtgatatagtaccatattcttgtaattttattggaaatgtatttaacatgagtggatttcaattattaatacctttgttcgaacaagttgatatgccagtattaactatggtagcagaaacagataatgcttcattctttaatacattaatatcacttttcactggtttaataagttattctgaagaattccaaaatttattcttttcgaatgattgcgctaaattattagcttatcaattaactaaagttaatcgtaataatttctcattaacatttttcgattcattaaatactttatatgattcattaattgatgtttcacataagaatgaaattttagaatatatattctttaatattaacatatggaaaaatcatcaaaaattaacaatacaaatattagttgagaaaatatataaaaaattattacaaaataatacatctgttaatttattacaaaatttaggatttatctttttgtttaatttcattattagtattaaatcaagtgaatcacgtaaaatattatatgagtttttattattatatgttaaaaagaaattttctttatctaatatgaattatctatttcaaaattgtttaaataatacgaaaattgaaattcgattagaatcattagaattaatgtataaattaattgaacaaaaaatctttgatagtcgaaatatattattacatcaaaattattacttagcattaattaatttatcttctgatcctaatgaagaaattcgttgttatggattaagattcataatattatcacaaaacttatatcaaaagaatcaattacaaactataccttatcctttagatatagcaattagtttatatattaaattttataattatgaaaatgaaactatcaaaatttgggatgaatcaacacaattattatttagtaatcctgaactttcttatggattattacaattaatagcatttatttcaaatcattttagtgataaatgtatggaatttttgaataattttctttcatttattttgatacaaaaatcattggatcaattaattaattctttatggcatttatatatattttatatatatacacaatcttcaaaaccttcaatagctttacataataaaactttaattgatatattttcacatattgttagttatatagtaataaaacaaaaaattaatttattgcaaaatacaatttcatttttacatataatacaatataaaaaacaattagaaacagtaagttacttaaaaatgatttttttgaagttattagataatactgaaattaaagatgaaaatatatttatgaatgtatttcctgaaatatttaattatttattctttataccaaattatgatcaaaattatcaaaataatgatttatatcaaagacatggtattcaaaatcgaatatttttagttaaacgatttgatagtgattttactttattagaatttattaatgatatatttaataataataatacgaattttgatatattcttttcattatcattacgaacatcaaatggtacatgggatgatattgaattatcaattaaattattaatatttagtttgaaaacgattaattcttcattatatgataaacaaattaatattcaaaagaataatatcaatttattttcagctttaacatttttaatgggtaatatatttagaattgattcgaaatatattaatcaatttttaccattatataaatcacatttattattaattaataattatgatattataattgaatgtttatcaataatattaatgtatttatatcctattggttgtaaaaatccaacaatatataaacaaatagaaattttaatattagatttaatcaatggatttcctaaacaaaaagttattgaagaacctattcctgaaatttatggaattacatcaagtgaatggttacaatcgatatttattttaacagttccattacaaacacaaatgatgcaaaactttacaaaaatatgtactacgataaataatttatttaataatgaacttatatttaataaaacaattttttctaaatataataatattttaatttctaccattaaacaacaacatttatataatttacataatcaagaatatatccaaaagatatataaagatttattacaagaattagaaattaattattcattaaatattcatattaataaagaacaacattggaaattatcatcgacattagatttagattggagacataatatattacgaccgaataaacattttgatcaacatcaaattgcatcattattacgtgattcacgtgatcaaacagaagcattacaaagattacaatcatttaaacaaataaattcagggacaactaattcaacagagactacaactattgaagataatagtaataataataataataataataatgaaaatgacataaatattgatgattctaaagaagatacatatacatattcatttgcttcaccagcacaacatattaaattaaataattcatttcaaggtacattttatcttaataagaatcaagttcttaaagatttatatatggttttacaaagaaatcaatatcatattccatgtggtttagaataactacacaaaaaagttatttaataatatttccgaatcaaaatattaaggaaacagttattaaaattcttaaaaaattaaaattacctaatttaaaatatttacaaacatcgaattcatcattattagaacaagaaaaaattactgaaaaatgggttaatggagaaatttctaattataaatatttaatcataattaatttattttcaggacgaagttttaatgatttaacacaatatccagtttttccatgggtattaaaagattatacgagtgaaactattgatttaaatgatccgaatgtttatcgagatttaagtaaacctattggagcattaaatgaagatcgattagaacatttaaaggaattaattacagaaatggatgaagaaaacaaatttttatataaagttcattattctaattcatattttgtatcatattatttaatacgattagaaccatttacaagtattaatattaaaatgcaagataataaatttgataaatcaagtcgaattttttcatcaattcctcatttatgggaatctattacatcaccagatttaacagattatcgagaattaataccagaattttatagtaccccacgatttttaattaattcagataattttgatttaggaatcaaatcagatggaaggaaaaattaatgatgttatattaccaccatggagtaaaaatgcgtatgatttcattgagaaacatcgagcagcattagaaagtgattatgtaagtttaaatttacctaaatggattgatttaatatttggatataaacaaaatgggaaagaagcaattttagctaataatacatttcatccttatacatatcctacgaatatgactaaacaagtaatagaagatccagaaaaagttaatttttattttatctttatttacaccgacattacaaattgaaataaaatcgaagccaatatttcttcgaacgacattcaataatattttaattattattacatcattaggtaaattaatattaaagaataataaaaatgaaaatatttttgatattagttattgtttaacaggatttcaaggtatttcagaaaggacaatttcatatcatttaaaaaagaatattttaattatatcaacatgtaatgattgtacatttcatatgtttcaaattgatattaataatttaactattaaattaattaattcacaacgacaatattcattaataaattcattaaaagttacgagtacgaatgattttgttaccgcttcacgaaattattctattattaaatggaattttacacaaccagcgacaatgaaattccaaattagtgcacatccagcgacgattattgattttgatatcggtattgtaagtaatgcattaatttgtggttataaatcacgacaaatttcatcatttaatttcttaaatggttcttatcaatatagttattcattagattataatattttaatgttaaaaattagtgcatcgccttgtatattgatatgttgtgaaattattaaaaataaaattttaaaaatattttcatatggaatggatttaaataaaattgaagaattggaaattcaaagtccgaaaatacaatggtgcgaaatgattattgcacataaggattacgtgttggcagtgtccgacttaaataacaagttgacattgttaagtttgccgtgtttgaggattttaaggactttcgagttacaggacgcagtcgtaacgatgtacttcgactcaagaacaaatgttttgtattatgggactgaaaataataaggtgtactcaatagacttccattaaactttaagaataaataatactatgaataataattaattttttgttgttatgaatttttcatcatttttttcacaaaaattatcatcaaattatatgaaaatcatacaatgaaatatgatataaaatattcgatttatcaaatttaatgcgttaataataatatatgaaaacaaaatgaatttaggaaatgtttatttcaatatttaaatatttcctcttttatccttgtgaatcttttaattttattatgtcgtcacatttatgatgttgaattttgtcgacaaataatcgaataatttctgcatttttcttttctgatgctatcataagcgctgttttatatgtttataagtaattccaaatgtttatatgaaatgtcatattttttaaaaatattataaataaaacaaaaaaatatttttagcatcgatatcaatattctcttgttctagaagtaatttaactatttctgtatgaccattttcagatgcatgcataagtgctgtattaaatattttaaataacccccaaatattattttgaaatatcaaattataaaaataaatattaaatataacaaataaatatctttagcattaatatcaattcctttttgttcaagaagtaatttaactatttctgtatgacctttaaatgatgcaaacataagtgctgttttaaataatttaaataatttccaaatattattttgaaatccaaaattattaaaataaattttaaataaaacaaataaatatctttagcattaatatcaattccttcttgttcaagaagtgatttaactatttctgtatgaccacttatagatgcacaaataagtgctgttttaaataatttaaataatttccaaatattattttgaatttccaaattattaaaataaattttaaataaaacaaataaatatctttagcattaatatcaattccttcttgttcaagaagtaatttaactacttctgtataaccattcgaagatgctaacataagtgctgtattaaataatttaaataatttccaaatattattttgaaatataaaattattataataaatttcaaataaaacaaataaatatctttagcattaatatcaattccttcttgttcaagaagtaatttaactatttctgtacgaccatttgaagatgcataaataagtgctgtccaaaatgatttaaataatttccaaatattattttggaatatcaaattcttaaaataaatttcaaataaaacaagtaaatatttttagcattaatatcaattcctttttgttcaagaagtaatttaactatttctgtatgaccataataagatgcccaaataagtgctgtccaaaataatttaaataattttcaaatattattttgaaatatcaaattattataataaatttcaaataaaacaaataaatatctttagcattaacatcaattcctttttgtttaagaagaacttttgtaacttcagaatgacctttgcgtgttgcccaatgaagtgctgtttcattaattttatataaattccaaaaaaaaatattaaacgttaaatcttcatgagaaacatattttaccattaatatcaaatattttttgttcgatttgccattcaataaatgatacaaattctttttggtgttgaggaagcatctggtttttaatatatttgacatttttatattcggcattttttttcttcaacagttggatcactcgccgatcttaactaactgaatcgcatcgaaaatttttttcagataaaccacagaatgttagcagcaatgttgttgtgtaagtaacggccacggattttgcgacgtcgctctgaaccaaatctttacaataaatcattaagcctatattcaaacattgtactcagatttgctttattgatgggaaaggattttaaacactttattttatttacaaaatattattaataaactaaaataagttcattctcatttttttaacttttactgctgaatttggtgtacctgtctttctctaacattttatttgcatttgacacaatgttttttgtcgctgccattttttttctctccaaaatttcgtaattgttgttaagtcttcaaaaaagtcatgatttcactcaactttaacataaaaattatattttttgccatacttttcggaggtgaatatgatgactagtcacaatcaatagtaatgtttagcaattataaaattttctatgataaaaaaaaaaaataccttatgaagtaccgacacaatgttccatttttttggaatattttcaatttattcaatgtataatatttatatttagaatatcttttaaaagctgatggacaagttttagctatttttctaaatagttctctatgcatatcataggtgtggtaaaaataaaaaattcttgatgaaaattatcaaacctctactatatatagaggaacactcttatatagctatgaacaaaaatttgaccattggaagctaaaaattttccactttttaactaaaaaaaatatttgatcgtctttttggctttaaacctgttcgttgatggcactgtaagatttcttttgtacgtatcggagaaaactcatttatttttttaattattcttataactcaacaaaaatattgaatcgaatttattcacatatattaaaatgttcaacacatattctatatataaatattataataatatctaaataatatctttaaaaggaaagatattttcattttgtcaaaaaatgtaaaaaataaacgtacttgtcgccctttctgtcaatttacataacaaaaataatcaacaaattcgttataatatctcaatattgtccatcagaatttccttgagacttggggtaatcaatttacagtatagcccatgtagtcaaaaaagtattgactcccggtatttgaagtttctccacttatgttttattcgtaccaatcgttcaaagaaagcctgataactgccgaaacacttttgaacaacattcaattcagaacagttgctatgaaaatttgatcgctcattcaaaaatgatttagtttaaaagttgcttcaatggtttttatgatctatttccttgttcatgcactctcagaaccacttacatttacatctagggcaacttgtaattcatcatatgcatataaaagaggaggaacatatctttcttggacgaatctatcagagagtaatgtgtattataaaatttttcaaagcaaaggtaatctcaatggtgaattgaccaattggggacaaattagcacatatataaaagggacttttataaatgttctaaatgtttacccaagtcaaattgatggttacaatggtcaaacaaatttggataaaggcgactataacacatctttagttaatttcacatttggtaatgattttacacagtattcgttgccttcatcagctgcccttaaggctatattagaaggtggcactatgtcaacaaaaaccagcaccacaatcttcaatccaaatggagttgatccaagaacaggcgaacaagtaatatatgtcacaccaatttcaataaataattttgaatctaatatttcagtagaaccaaatttcatatatgactatgatgtgattttctttggttcagcgaagtatagttctggttataatattcttacaacaacagccacaaatgttattgctgaatatataaaaaaagggtatggtgtatttactggatatgattccattgatgataatttttatatcaaaagtaatgctcaaagcctgcttgcaattcgggatctttttggaattaaagtatcaggagctgattcaactgttaatggcggaaaaccatcttatgtgggctatagtacgaacaatgcaaaagttatacaagatggattacttatgaactacccttataaaattggttcaaaagtatcaactatatatttgaattctatatctgcatctggtgcatctacaggagatgtttgggcatcatacggtaatacagaaagaggtgaattcggacttcttcatggttattacttaacaacaaataataatacggcagtgattcaatcaggtttaagtaattcaaggccaatagaaggtcaaattattgcaaatacaatattttatttaaagcaaaggacttatgataattttattgaggatcattcagcacaagattttgagccaccagtagttaatatttcttataatgaagaagaatatacagttatgatcaaaggaactgatgttggatcattgtataaatataaaattgaagcatactcaaggaataatgatgatttaatcgcttcaacggctgaggttgaagttgaagtatcttcaggaatcaaaatatataaatataaaataactccaaataatagttctacctcaagtgaattattatctcaaacaaaaaataattttatcaaattaataaaagaacaaataaaaaacggaaactatgtacacgttgcggctgtagataatgcaggaaacattggtgaaatagcaagtatcaaaataccaattccagagccaaccaaatcatttactaaatccaatactttttctaaatcaaatgcatttactgattcgaatgttatcactaaatcaagtacaacaaataaatcaaatgcatttaatcaatatgacaacagtttatcacatacttttgtttcgattcattctatttcatttactcaaacaataattctttactcatatatatcaaagactcaaatgaaatattccggtctcagttacgtttatgtcgattctatatattataaatacactgttataatttattccaaatattttgttttttattctaattttttcacactttttacacaaaatgatggagataatagcaaaacgaacattgctattgcaataagtattccaattgcagtgataataataataatttgtggtatattgataatgtttattattatacgtagacataagcaaaataaatcaagtaaagaaaatagtgaaattattgttcctacagcaggaacatcagaaaacttttcattaaatgacaaaccactgagtattgaagaagatccatttgctcaagattttatggaagataattatatattaatatgaaaattagatatttttttttcatatacgaacaaggctacagcagctcttaaatacagccttcacaaaagtgtttggctgtaacatctgctcttgatatacaaagcaaaaaacttttgttgactgaaaatgtagtgatggaagttgttgtaattcttcgcaagacgttttttgattcgatataaaattgggaatatgcctctatgtgtaattttaataaatagaaaatttattaaatatgtaaatggttgtgtattttcatgtgtgaaatgaaattataaactttctataggaaattaatgaatgatcatttttttttattatagaaaattataaacattcatgtttaaagaccatataatttttaaaggaaatactctgattggggcagcaaaaaaagttatcaaatttgctcagcacttttccaaaaagaaaaccttttttttaatgccatcgctatgtgaattgtttcaattcaaactaaaacaaattaaaggaagaaaacccattccattactcgttcttcctgataattctgtaatgaattattttagttttttttttttttaatatttaccaaagactatagaatgtataattaaaatatcaagtagatgagaatttaccacccaaaccgattttttattcgatctaatttaatatatcatattttttcaaataataataattgcagatatgttttttattagcctcgaatggacatgctctaaaatggaaaatgaatataataaatgataaaaatttatgttttcttacatatcctgaaatcgaacaagtttcatttagcaattgttccaatctcatcatttatagcggttttcaaccgtcatttttatttgaaaaaaattggattttcaactttttgaaccaggttttacttccttcggaaagggatctgagaagattcagaatattttcataaaacgatttgggcaagatggatgcgtttcggttgaataatgaaatattttttaatgaaaaacttcaagtatatgagataaatgatgagctgcctttgggatggcagaaagataataaagttattcattaatgaattgtagtatataagttattttcgatatgtgaatgcacattcgggcatatattacctattaacatatttcaaaatttaagtattccaaataaaattaaagatgtgaatggatttcaccatgagattcattctatgtttttatttattaattttttacaagtaatgccactttttgagcaaagctcaaaaagtgtctccgccatctctcttttctatttttacaaaattattattaagaaaataaattaatttaattttaatattaattaataatgtaattcacatgacaatttgtattgacttcgagaaaaagatgattaagaaaatatcatattttattgaaaaaaccaataatatatcaactacagattacgcacaaaatcaaaaataacgagaacaaaatcatggaaatgattgaagttaatatctaaaaaataacttagatcaatatcctataagcaggaagaaaaggctcgaatttataaataatcaattttactaattttctttctctctttaaattctgaatataatattacaatttgaatttaaatagctattttcataataaatgtatttattaatcttaaaaaatattgtttattaaagaagatattttgaggttcaatcactttttatttaaatcggttaaactgattttataataaacatagatcataaccataatatcaactccttaatgttcaagaagtaatttaactatttctagattaccattattagatgctttcataagtgctgtgttgaatgtttagaataatttttaaatataattctgaaacataacattaattacccactttctatcgtgatgtgtgtttttaataagtcgagtttctgtgagagataatataaataatgtaagaagaaattttaatccatatatgaagattaaaatcaaagtttaatacaattattttgttcttagttcaaaaaaattattcatcaatcaacgggaaaatcattggacttctatataattgatatatcaattgattgatatttatgataggaaagaaattattaaattattatacctagaataaccattatttatattatcataaaaaaattgatttgtaggaaaattatataattttcaaaggcatcaaatttaacaaagaaaagaaaatcttatttaaaggtgcggcacactaaattgaataaaaaacgattattcgataaattcataaacggtctcttcggaaatttattttttctcaagaaatctcgtggaataatgtaatacttacgattaaaaataatcaatatttctacctaataatgtatcttttatttattgaaaaattaagatttttgataaaatatgacagataattaaattctatataaaaataaaataaaaaaaatggttcttttacatttttataaattttccgaagatatcttccccgggtcttgaaaaagaagaaattgaaaaagtagaagaaaaggaaaaaaattaagagaaatgatgaataaatcatcatgaaagcataattcaattttgaaattaatatgagaaattccatgtaataatgtgataatatattttctgaaataaatttagaatttagaaaaagaagagagaaaaaacaaaaaacgcaaaatacatcaaaaaaattgaattcaaaactattattttttcaattcaaaatgtatttattttatttttttgtaaaaatgtaatagaaagattttttcaatttatttcaatataaattttgattatctgtcaaattttatcaaaaatcttaatatttcaagaaataaatagtacatcatatggaagaaatattgtttatttttaatcgtaagtaatgcattcaaccgccgagatttcttggaaaaaaataaattttaagtagggcagtttatactggatcctgataaaagaagaataataagttaagaataaaataaagagaagataaaaaaagaaaaaaattgataaaaaaaatgaaacaaatcattatatataagagctcgctgattgacatgatatagtaaaaaataaccagcgcgaaggataagaaggaaaaagtacgtaagtaaatcatttaattcgaagatgaaactttttctaataataaacttttcaatattgaatgacgatatatgtaaagaataaacatcagaaaaataaccgaaattttctaggaaaaaatgtgagccgctttgatagatgaaattgaatgataatttttgagaagaaattacggttagagtgtcaaccgactgttttgttcttatatattaatacttatataaaaattcatatcacatgtccatgtaaataaaaatcaagtttcaataattgacatcttttctcaattccttcggaaaaataactcacaagaatctaattatcttatcggaaagttgatagaaaaaggtttaattaactcatcgattactaaaaatatgaaaaatttatttttttcacattttaaagcacatttcgttttaaactatcgttatcaattttctgaatatttctccaaaaaccttgaaaaacttaaagcgaataattgggaacttcatcagaaatatgttaaagaaggaataaatcagaatgaaattgcgaaaataattcggaatgatgaaatagaaaaacttcaagaagtatcatcacaaacaaattttgacttcaatcaaagaattaaaccatcactttatgaaagatattcatttattaatcataaaaatgttacattaattgattatgcagcatttttttcttcaattaaatgttttaaatatttacttatgaatggttcgaaagtaaataaaacaggtaaatatgcaattgcaggtggaaatgaagaaataattcatttatgtgaacaaaatcattcaacatttgaaggggcatatgaaacagcaataaaatttcatcgaaatgatatctttaaatatttttatgataataagttaaaagaaattaagaatttagaagaattaggagtaaaatgtgttttacatgataattatgaacttttatcatttttacttaaagaaggaatgaaaataaatgaaaatattctcattgcttcaatcataacagggaatttatatattactcaatattttctcgaaagtaatcatattcctattgattttttgaaaatttcgggtttttctggaaatgtggaactttataacaattgaattaacaatagatacattgattttagcaagattgtttgtttatttcattagatttttattaaaatatttcatcgtttcataaaaatttttaaatttttttttaaatatttttagcactaacaaatgcttcaaaaaatggttatacagaaatagttaaatttcttcttgaacaagaaggaattgatattaatgctaaagatatttgtttgttttatttaaaatttattttaataatttttagtattaaaataatatttggaaattatttaaattatttgaaacagcacttattgatgcatctatatatggttattcagaaatagttaaattacttcttgaacaaaaaggaattgatattaatgataaagatatttatttgttatatttaatatttatttttataatttgatatttcaaaataatatttggaaattatttaaattattttatacagcacttatgttagcatcttcaaaaggtcatacagaaatcgttaaattacttcttgaacaagagaatattgatatcgatgctaaaaatatttttttgttttatttaaaatatttttaaaaaatatgaaatttcatataaacatttggaattacttataaacatataaaacagcgcttatgatagcatcagaaaaaagaaaaatgcagaaattattcgattatttgcagacaaaattcaacatcataaatgtgacgacataataaaattaaaagattcacaaggataaaagaggaaatatttaaatattgaaataaacatttcctaaattcattttgttttcatatattaatgatgaaaaattcataacaacaaaaaattaattattattcatagtattatttattcttaaagtttaatggaagtctattgagtacaccttattattttcagtcccataatacaaaatatttgcgaggaatcgtattccagggcatgacggtcgtttccattgaattattataaatttatgttttcaaattttttgtttttttggataagtagtgactctttacgccaagtgaaattaaatgaataaaattgaataaaataagtgccgttttgtatcatataaaattaaattaaaaaaattgaatgggatcagaattgaataaaaataatttaaatcaaaaaatcatcttgtatgtaagattgaaagaatttcattattgtaccaatcataaacatattattactataagaaatattgctattattatatgaactggtgaaaataattcggcattacgatagattgaaaaatgataagatagtatgtaaacttctcaaaattgacaactgaattattgtcgatttaatttcgaaaatctcttttttattcaatttttattaataaattttttaattttttttccaatatttctgcctgcttctttcttacacatgtgtaccacctatttttgcatgaaatcggatctcttttgtttatatgttgggaaatcaatttttgatgatttttgatgttcaatttttgttaccaaatcatgaagtaacatgtcctcttcttctgtccatcgcgtatagtctcttttttttagtgtagcctcttttaaatctttcgctaatcctaagaatcttaaaatcgactgcccctccatttccaagcagaggcgtaaacggtcgacgaaacccgaacaaagcttgttaattaattccatgtcaagttcattccaagttttttcaagcagttttttaagctcctctacagtgctcggcatttgttcagctacaatacgcttcattattgcccatagtaattctatgggatttaagtcgggggagttgggtggccaatcagtaatcacatcgagtcgctcctccaaccaatcaatagaatcaacagatgtgtggcacctagctccgtcctgcatgtacacccaatctaattttccatgtagttcattcatcccattgatgaaatcagatttaatcatattctctatatattgctcagagttcacagatttttgtattattacaagtttgctcttatagttacatgaaattaccccaaaaatcataattgactggggaaattttacatttcttgatattgaatttggagtataatctcctttgcttacccacacccatctattgtctttacttaatacaaatctacattcgtctgaaaaggcaattttatccaaaaattgtgtttgtgttaacatttttgagcaaaatttttttcttgcattaatctgttcttcgtttaaaagctgttctgttttaggaggtcgatactgaaatctcatttcgtttctaatttttgagacatattgtggtgaaattgatttatgaaaaatatcttctatttgttgtgataatttaactgatgttaatgatgcgtcttgaagtgttttaatttcgatatattcttttatttgattattaattacttgaggccttccacgttttgattgttttggaatttcattcgttgaggtaaactgtcgaattgtatcaccaactcgatgagttccaacatgcagtatgtctgctatttgtttttggctgaatccttgtttgtaaaggttgattatgttctcagccttgttcatccctaataattaacggtctgtattcaaaaaattcattgagtttcctcaatgccgatttattttcacaagtttatattattactattatctatattattactaaccttatatgctattaacgttctgagtggtggtatatatatatataattagaacgttattttaaaataaaacgaaacgatgttcattaattcaaatgaaaaagtaaccatccagaagaaactttaaatgataaccattttgatttttcttatgctctattaagcatttcagacaaaataaatcacgaattagaaagtttaggacttacaaatccatcgcccaaaaatgacgaatgatatgaaacaccaactgatttcattaactttttaggtaacttgaaaggaagaaacatcactgaatataatgaaataaagacaacaataaaagatgaatcaattaaaaagatttgcccattttcatgtaatgattcgaatctatattagaaaaaatgtcaatatataatatacgaaattcgtatgcaagtttcatgcaaagaaattatatgaatgtccaacgacttttacaattagaatacaaaaaaatataatatatcggattaataatgaaagcctttatcattgtcatagtctcgagaatcgataatctagtagaaagcaagtttccccttttaacttcaaatcaaaaagacaaaatgaataaagaagcaagatttggaatgcctacgatctcattcgccgttttaatgcaaccaattttttggctagtcaattgtataatataattagacatgataaaaataaacaatttgaaaatgaaattgaaaacctttatcaatatacacaaaaatgtaagggataatatgatatggtattaattgatacagcgccaaccgaatgcttttattcatttaaatgttctgttttaagtttggtatgtctttcctttcaccgagcaacaacgaagtttttatggtaattattattaattatttatatcaaacacaattttcgcccaatttttatcgacacgattatcaacatcaattgtttttgttttcaaaccaacgtttttttatcagaaaaagtgcgtctcaaatttgataactgttttttttccgacgatagccaaaatactccaatggatggaattgaaaaaatatattgacaaattttttgagggtcccactttgtgtacattttcgactaaaaatctatttcctttgtggttaagatcattcactctttatataaaaattatataattttataaattgttgcttgcatccataattgttatccaaaacttgtaaatattttttgaaaaagaataactcgtaagcgcgaatatacaaaattaatagcttcagttttttaagaaccaacaattctcaatattaaattacattagtcgtttaaacaatgctttatttacatatttatttcattctttgctttggaagaaatcttcgacttcaacaacgtcatcaaaagggttaaaaatcgaaagaaacttcagcaaatatttcgtgaatgtattttgtggttggtcatcttccaccggaacttctgctgtttcttcgttgcctatgtatggcaagtcctcgttctcattgattgacatattttcttgcgttgttttatctgatttcggaattaatcttaaaaatgaagatggacacatttgtgcttgcttaatcgttaaagagtcatccaagtcatcaatgctctttcgtttatgtgttaagaagattgaaaatcctggtccgaattctgactcgatccattcacgtaattcttgaagtcttgaattgattggaaattctttagtgacaacacgattattaaagtatacagcaattttagttttttgattggattttacttcttggtcggaaatatctgatttgatattatcagattgttcttcatttttattgaaataattataaaattcttgagcagatggataattgtcagaccaggaataggtaaccccatttgaatttggaccaaatacaaataaagatggaatatttgaaacaggaaaaagttgtgaaaattgtgttatttctgtttggtttgaaagttgtgatattctcaaaatgatgaaattttctgaaacagtagcatgaactaaaggattatcccaaaaataattcatgatgttttgatcagtttcaatagatacgattaaagtcatataagggtgttgagattttctgttaagcgcctctgtgacattattgcaaaatggatcctgttgcattcaataaaatatgtcagaaaattttgaatcgttttatttttgtcaattaattgtcaacttataagttttcttattttccctgttgttagaaagacatttattgaaaaaggcatgattattaatttatatctgtgttacataatcacagtaacattaaataattttggtacacatgggatgtggaatataattgaaattaatttttaaatttaaacagtaatattgccctcattatgaatttatgatgcactaaatagtgtttatggaaaatatggtgaaatattataaatcaattgatttgtgaatgaaaatttcatttataacttttaataataaagttatatatacttgcttgagcatctttatgatgacatgttaatatatcgaaaatcattgttataacaaaagaaatgaaaatatatttcgaaacgaattcaaaaaaatacagtgaactcactgtcctcttgcttagtaatactacagagctagattatatgttttttagtcatgattaaattgaagtcttgcctcatttttttttcttgaaaacgttcagttgcttcaattttgtttgacaaatatttgacactgctatcaaattcataaatatcaccgcagaaaactgctctaaatatcagacgatatgatttttttgactaggtcgatttgcttaactactgaaaaagtgacaagcaaatgccttctctttcgagccaactaaaatttatccttaaagataaaacatttgcaccaaaacaatttataacaaatagctttgctgagtttctgaatctagtccttgaatttataagtattcagtctgaatcacctcaaaatggtcgaaataagtcaaagaaagacaaagaaattgaaaaaatattcaataaaatatttagttcattttcaaaaatatttccttacttaacagagagtacaattctacataatgcgagcactttaaatacaattttctcaattttgatgcatccactttcacctgaaagcatacgtacaacagctctcaacctacttcttcagttaattgttttagtcgatgaaccaaatttagatttatttcatgattccttaacttttatgattccatataacagattttctcgtgatccagaagaagagcaaagtcttatatctctctttcaaaatgttaagcacatatataatcctgatccatcaacgtccaccttagaatctgctgaatcacaacttaaccttattcttaagtttattaacaacaattggtcagcttttcctcgtacatgtgttcatattctttccaaatacattctctccatcacctatcatagcatagcagaatcatgtccaaaatgtgctttagatgttggcttcaaaagtcctccacccgaaacctttgtttcacaactttattattttgttaatcaattcaatgacatcaaaaatgacattttaccaatatcacaatcttcagcgattttatccattttcatatacttttttgaggcaaccattcccacacttaacaaacgcgacttaattgcgatattaacatttttaacatcgcttgtcaagatcaaagaattatttaatgattcgatggacaaagccattaaaatcatcaaaatatttatccaaatattagaagatccggatccagagaacaaagttgtaataacagttgccgaacgatttgttaccaccttttttgattcgattttttctttacaaaacatacaacaaatttcggaattttttgttttcatatttaaagaatattcatccaaaagtgtcagtgtttcatttttattttgtttcttattacaatttattacaataagacaaatcgacttaaaagatttaatacatatattaattaataataacacattatatttatcaattgctgttcatttttcacaaatattcgcagtcgaatcatttttaacaatgttcgaaatgcaaatcgatgaattatttgaatattgtgataaatatttacaacttaaaaagaatgaacatattatcaaccacaaaaatgattggttatattccaatcttcggaacatatttaatgagtcgaatttaaagccgattccacaaatatcgttaaaaatacaaaaattcgaaacttttcaaaaagaactttcgtttatatctattccaagaattacagaatgtaacaaaacaatgataaattattacatttcattattcgatgacatgtcaaatgaaaatttctgttttccattattatcatatttttattcattggtaaaattaaatgtttggccaatggaaatagaacaaaacgagtataacttaatattatattcgtttgaatatttgattaatgttattacatatcaaaaaaatgaaatttcatttatatcatttaacattttatataaattaataacgaaattatcatataaaaattgttttgatataaattcattaacgaaattatattcaattgttattgagatgttattaaatcaaaatgaagaaattcgttacaaagcatttaaagcatcgatcaaattcataaaaaatagtttttctggttcgcaatttttaattccgattttaatttgtttaatagaaaaagaaaaaattaaattaacaaatttaataattggattcattacatcatatccattgttcattaaaacgttttattttccagaagatttcattaatgatgttaaatcgatgttaaatgatgaaaaagatcaattaattaatgattacgaatatgttttggattataaaaatgagaatttattcgatgcagtaattgaaattttaaataaaatttcattcaaggaatttccgttaattattcactcatatgttcaattgatttctttcgttttactttcaaataataaagtgaataattacattataaattcatttgacagaattatcgaaggaattaaccaaaaaagtgacatagttttgtatgctttactgagttcgttgccgttatttcattcaatctcagaattgtatcaaaccgaaacttccgatttcattgaaaaaattgtcagactttgtttagttttaaaaaatattgaaaacataaattggtataatacatttctattatattgttcatctttattaatttataattataatttgatctataagtccaaagtttatgaaatttttttgaattttttaatggagaacaaagaaaacaaaaatcaaaaatttgaattgtcacttttgttgttaacatctcaatttgggttatacccattcaatcaaatctttgatgcggaaacaaaaaacgtgtttttgactcaatttggaaattattatattccttcaaaagatggcttaatgtgcttaagtgattctggaatattttcatgggaatttaagccatttaaatcagacgaaaaaatattaccaaatattttcgaagatttggaaacaattaagttaactgatgaatttgtcccagactttcaacagaactttacaaggcctttggctgaggtcatgaatattataaatttaagatctgatctaacaaattcattacattcttttccattgattaatgaaattatggcatcacttaaaagcatagaatcatcgtatgaaaaggtcatgcgtcaagtatcagatcctgtaaatgttgttgaaatgagtgaaatttcaccattacaaccatcaacaccaatgacattacttggaattcttgatccacttgaacccgaaacattgttatctttacctaagaatcaagaaacaaaggaatttttaaaatcatttcaagataatctatcaaagaaacatttgaaagtaggtttattattcacggatgaaaaccattcaaagcaatctgatttgcttacaatgacattagaagaaacctctccaagattccaagagtttttagtttcattaggaaatttaaccgttatgaagagcggttatgacagctttacatcaaacgatagtaaattgaatgttttactttactcggacttgttatatgaaatatcgttccaaactccgacactttttaagccaacttttgatgatccttataaaatcaagaaaatgaatttaatacttgagaatccaatagttattgtttggatagaaagtggcagaggttttaatgaaaatatatttttatcaaattcaaataaatattacatattagtttatccattagaaaatggattattcagagttgacttaacttctacgggaaaagcaatggtgaaaacacagattgtgttaaagagaatgttgacatttttcgttcgtacaattatcatttttataaatgaattcataagcccccagacacataaaatggaaaagccaaatcacccggaggctaaggcgcaaactttgtgtcaaacttatatcgatatttgttattgaataaatctgttatttttttttaagttgttatttcactattttaagtaatgacgattcctaattttactgtgcttttgtaagcgatgcgtcaaatagttcaaaataatttcgaaaaatatcttctgtattagttccaatttcttgaggaaacaattttgcagtaaattgatatccatttgtccttttaatgataacccgctttaaaaaaactcaattacataaataaagagaaatgtgaaatgaaatcaaatggtgaaattttaattaattttgttcatccgcaagacgtgcaatctaaaagaacacctgctatgatcatcaaaacaaaagcagcgaagaagacacccaacgaaacgtatgaaaaaatctcaatatcatccggaatggaagaaacacatctttttgcttctaatgacaagcattctgttcttaacgaaagtattgcacaacagccaaatgctttttcaattgcttctgttagtttatcattgtagaaatggattcccaagtaagttacaacatcttgtgcgaagccacccttgtatatatatattagaatggcaaatactgctccaatagccccataaatataaaggaaaacggaaacagaaattctgaaacctttggaaccagcgcaaccaccagaaatcgacataaaaagaacgaaaacgccaatacaagtaattacaattaagataataaagaatgtttgattatcataaagatctttgatcattccaaacttaacaacaataacaatcatcagtgctaatgaaaggagaactcctattattgagaagagcataatgagtgcgtttttacagcagcttggtttgcaaggcattactaaacaatgaaactttttattatttcaacttcttttcaatcaaaaatttgtcaaatctgtacatttcattcaaattttctgcgtttttggctctcaactagtgcaatttaaaattaaacggcggaggttttttgccagacgtttggacgataacacgcagaaaaaatcgaatttattccgaactttttgataaaaattacgtgcgcacgatcaaaagtgtttttgaaaagaaaaaagttttccatcttctgaataatagttcgctttcggttcatagaaggtgaaatatcatctacggtcagtgagtaaaacaataacttcaattaataatagcatctataacaaagaaaaacgatatatctgattcaattaaaatattttaatacaaaagtgttataagcacaacaaaatttactgtttcaagatatatacaagaaaataaattacagttttaattaaattttacaaattaatatcaatattatgtaatattaaatttctgtcgtactgcgttctttgtctgttgtacttctactaatctcttctatttttggttttgtttctttagttttaagcatatctaataatgacttttgaacttttgtttcaactttaattggtgcaatacattcagcaccagtatatcctggacgaagagaaagtcttgaaacaggataaaatgaaactattggttcattttctttgatcaagatttcccattttggacttgaccataacgctaattgatcaattccaaagatgattggcattctatggtgtatagagttaacttgttttgttgcttctcttgttaaaataacaaattctcctctttgattataaaatgcagcaaggaacataatttcatcattttgcttatggaagaaatatggctgtttctccttgttccattcgaaatatccatcagctggaacaacacatcttctttgagtgatatcattttggaattttttcataacagtttcaacgcgagcattaataactgtgttagttaaaacctgagtaccccataataaaagagaaatttcctcagctgtaacaattggtgcaactgatcctggggaaatgttattagaaggagtaaaagtctttccatttgtattcacgttttgaacaccagcaactcttctgatttgtgcaagtgctctatttaaagcgaatctaccgcacataaaaatattttatacgtttatttttgaggaagttcactttcgatttgagtaagtttgtttgattggtctgatcgttttttgttcaaattttcaattgtaaattttgacggatgaactcctcgttgagaaggaagttgttattcgagggagaatttgagatggtctactaatttctctttgagaagacatggggaataccactcttaaccttgcaccataaggactaaaatctgacaacactgaattatcataaagtaattgtaatgagtttgcatcattataataaaacctaatttctttcacctcgtcatatctgtcttcttgtatacccaaacattgaaaatatctaattttcgtttcgccgaacatttcaccaggaataactttaaatacttttggtggatatctttggttaaatttaatggttgtatcatcataatcccaaacattcattgttggaattaaccattcaccttcatttaattctatttgatcatctggaatgtattccaaacgtaaaggattatgtggtatatcactaacaaagctattttcaggacaaattctttcgattacatttcttttctgcattaataaaagtcttaaaggaggatgattaagttttaattcgaatttttgacgtatgtcatgaatgatagctctaatacttaatctttttggataaatcacatgaacgtcattagtttccccatttgctaagacgaagtatattaataatcgttttgtataagtaaagcattcaattgatatttttctgaagaagtggaattcaatactttttgccctcgtgcaaatttcatatggtatttcatcgtcactttctataaactcttgttttgctgtcaaataaattaatattaaatcgaatttataatcgaatttaatattaaaacattttgccaaaaaaattttaaatttcaaaaatgatatagtttcaggcactacaacgtttttaacttttttttcattacttaaatatgtgactttaatttcgaaagtatttctacaataatccaaataatttattgggtttaaagggttttgatttaaaatttttaaatacgtcgatttgttatcaattactttcccatactttgagatatctttaaatttaattttacgatttatttgagttatatgatttggttgtattaagatcattgcagaactcttcgagaacaaatcattcatattaacattttcttctatttcattattactaataaagaaacattttaaaggcgcttcaggcggcatattaaatttcattcgataaatttccaaaattttttcagggctatcatcgattgaaattattactgaaaacaagtaatgtatcggaaaataattattccataaataagtataaacgaacaaaataattttcttgtaatttgtattactaaaataatcatcttcatcatcagaatcatattcaaatattaattcatcatttggagtttcttcatgtaataattcattcttataataatatacaaatattaacacatctttacttgaatataatgatatatattgatttaatgtattagaagaattaggtaatatacatttaatagtattataatgttcaattaaacataacttaaactcggatttcttgatttgttgttcgacttgtgcatataaatattcacatttatcataacgtttaacatcgaatttttcacataaaaatttctttgtcttaaatgaaaagttattattttgtgcattatattctaatattgtatcatctactaaaccaatatgtaatgtattttgtatttgatatcttttttcttctttttctttcttctttgttaagaaatcatgataataatctatgattgatttcggtatatcatcattcgaaattggatgataaatattttggatttcactttgtttaatatatattaacatatatgccgaatatgtacgttcataattactcgtgctatatttatcaacacctccgaagttattatcaattgcttctgcttcagtagctattgatacactcgaatcattaaatttataccatttttcttctggagtagttcttaaatatgcaaaataatgtcctccatatgcataaccagaatgaactaatataccaaataattcatattcccaatcttcgtcttgattctcttctgtctgtattaaatatggctttaaatcaatagtctttggaaatgaaaaatatgaatttatcttcgtcatccgattataattaaagtcatattgaaaccttcgtaaatgtaaatgtaatactttcggaaactcaatgaattcgacgcccatatctgcttcttgtttcccatattcttctgtatcatatttgttgtcgccatctaattcttcatgctcaacatacttcacaaatgattcttcaagggaattacaattcacaacgtcaagttgtaaatcataaaaatattcactacgtgaactctcgtaatcaacattacgacatctgatgaatgaacgtgattccccacgaaataaatcgggaatccgaccttccaagttggtcttcttcatcttctcttcaagattatctaataaaactcgacaaaactcttggatgtcatgttggataaaactatctgaatcactccaaccaaatgaacgcgttaatgatttggttgagactggcgaatcagataattgcataaggccaaataatcgttgaagatttaagcagatgttttgatcatctgatttgttttgcatggtactatccatggtatatattaataagcgaaacgcgggaatgtggaaaagtgattgaagcatggaattcatgtaacaagtggcaccttggttacgaagtccaacatatgggatgacttcgggctcggaaacatgatatattggcgtttgtactgggattactttgactgtgggagtatatgtaatctcaatttcgataataacaacgtcatcatgtatatatcctttctggatatttgatactgcactttgaaaaactggaattcttattgtgtgcttggtttgaccttccgaaaaagaacattttatgggatttggattggtagttgtttcttttggtatttcattaatgactgaaaattgaaatgaaaattccttctcttctttggcttccggcatctcaactgttatctttacaaaatctgattcgcatctagtgagtgtaaaactaaatgtataatccccatgctgacaaataaggttgaactcgttttcgacgtttgaccaattttctaatttccacgtttctttgatatggaagccagaatccgtttcatttggcgcagataccccttcactttgtgaagagtattcttggatgattggttccatttcaagacgtcttggatggaattctgaaaataaatggtcaggcggttattgatcactggaaaaacaagaaaaaataataccattgtatcaaaatctagaaaataattcatagttttttttgcatagaaggagtgcctttcaggtattacttagttttatcgaaatatattaaattaaacatttattaatttttcaaaataatggctttaaaattccaggtataataaaagtcatgagtgttgctttagaattaaagtgatttcaagttcacttaaattacaagatatgatttttaaaaattagaaataataataaaagtttaatatattaatcctctgctaaaatgtcgctaactttaataacatcagtgcactgaagagaaaattcgagtgaaggagtgtcaagatcccaaagtctaacttgtccaacatcagcaatttttttaagttcaccttcatctgttgttactatgacaggcttgtaaccatctggaagttctaaatactttccaaataattgatgtcctctaaaaaatccaatatattgtccatttttgttttctgaaattctgctatcaaagtactgacttacctttgcaggtccatcatagttaatatgtgcaggaatccattctgctttcagtggttgagacattggtttggggcaccctgttccattttcaccaaaaatattaaacaaaatgaacttcttaatttttattgaaatcaattgtataaatatgaataaaaaatatgaacatctttaggttttgactttttaagcatttcaaacattatttttatcataataaattgtttgtcattttaaaaaaaatggaaaatttaatatatatataatttatttccgtaacactaaaagtgctttatactaaatgttgagccatttcttttacaattgcgaatctctttctaatttcatggtatttttctttatcgctcaagtccgacaaattcacttttattacttcgctagcgttgtcaaagtaaacaattttcgatgcagattcgatgaccagttttgtgtggtctctaaaatttgcttggatatctcgatttgccattctaaacaaaaccccatcgttagttctagcccaatatttaacatgtccaattacatctgttggcatattaatacgtaatggaggtgcagttaattcatttgctttttgttttaattcagatgcaaaatatttgatcaaaagtagtttctttcgatgtggcgattcctcgatacctttcatggatattatttcaggagctggcttttgaggtgagtcccaatattgtgctaatgattcatcaggtgtcattaagatccgagttgaatcattaaagcatgctccacaaatactgttgtgtagtaaataagctagcccataacgatgggaataatcccaccaaattcgcactgatgtgcttggaagagttaacggtcgctctgacaaaaccggaaaacggttcaagctgccggtgacctggcgagtgatgaacgggtgggagagaagggcgcgtgctggtggccgcatggctgggtcacgttgcaaaagacaatctacaaagtttcttgcgacttcagaaactccgcaattttccggccaagaatatgcaacatgacgaatctttttaagcgtttgatgtttatctttggactgaaagggttggtgccctgtaagcattagaaaggcacaaacacctgtggcccatatatcaacactagtagtttggccttcgcgatgaccaataacttcaggtgaaagatatcctggagtgccacatattgtcattcgtttttcatcgtcatcaatgattttggcacttaatccaaaatctgcaatttttaatttccattcactatcaagtagaaaattctgaagcttcaaatcacggtgaataacatgattgtcatgtaagtaaactagaccttcaagaatttgtcgacaataatctgctgcttcatcttctgagaaaacacgtttttgtctgagaatatctaaaagggttccattgggacaatattccataaggatataaatgtaattatcatcttgaaaaaccccgcgaaattctactatatgtggatgatgaagagaacgttgaatatcaacctcgctaaaaattttgcgcttaattctttcgcttgtgatgcgtgtttttgagatgcatttaattgcaattggtgtatgagatgggagttcttctcctgcataaacagtaccgaaacctccagagccagctttctccccaattacatagcttaccttggttccgtcatgagaagtcttgtgaagaaccccaggaacagggggcaaatcctcactattcatacggagctcgttttttcgttttcaatgcttttttcggtttgttctgaagctaaaagacgataaaaaattgagagcagttccaattttgcactaaaaacaaacttattcgattttgaacccaaaacatcagaattttgaaaaaatgtcggatttatatattacaaacatagtttagatgattaatttcgattttaaaattagaattgaatcgattgaagtaaattaactatcctaatatgaccattttcagatgcaagcataagtgctgttttaaataattaaaataaattccaactatttaaaattaatttcaataaattaaaataaattttctataaaaagttgaaatgtcttttgcatttatatcaatatctttttgttcaagaaggaattcaaccacagcaaactgaccaaatcgagatgcatgcattagtgctgtccaaaattatttaaatgaattccaaatatttaaaattaatatcgataaattaaaatgaattttctataaaatattggaatatcttttgcattgatatcgatatctttttgtttaaaaaggaattgaacaatttcgatttgattatgtcgagatgcgcacattaatgcggtccaaaactattaaaataaattccagataattaaaataattttcatatttttataacaaatattttatagaaaataaaaacattttttgcatttagatcaactttgttttgcttgataaggaatttaactgtatcaatacgtccatatcgagatgcaaacattagaccttctacaaatgttaagtgtaaatatccaataaagtaaataaatatcatttgtatcattaatttctttttgctcaagaaataatttaacgatttcaatatgattatataaaatagcccatagaaatgctgttaaaaataattaaaataaattctaaataaatcagataaatccaaaatttttaaattaaataaaaattatttaaaacaaatatccaatataatatataaacatcttttacatttatatcaatatttttttgtttaagaaggaatttaacaatttcaatttgaccatatttagatgcataaataagtgctgtttcaaataatatgaataatttccaaattatgaaaacgagcttcaattaataagtataaatattcactgaaacaaaatatatttagtattaatatcaatttcttcttgttcaaggagtaattgaacaatttcaagatttccagatggaattgcaaatattaatatgtttggaatttgattcttttgagtataatctttaagtaagaaagtgttaccatttgttactatattttttatgatcatatcatttatttccataccttctttttctaaaaatgaaaaaatttcatagttactaaaatcgatacattttctacctaatttagttaaatcatatatttgatcaaaattcttttcataaaaataataaaaaatttcatttcgatgaaattctattgctgtttcgaaacattcaattggatcttcagataataatgaaatattttgttcacataaacgaataatttctaagtttcctccagcaattgcatattttaatgtattatttacatttgacccattcattaataaatatttaaaacatttaaatgatccataaaatgcacaataatcaattaatgatacatatttcttgtttacaaatgaacatatttcataaagtgatggttcaatgaattgattaaaatcaaattttttttgtgatgatatttcttgtaattgttctaaattatcatttcgtaaaacttttgttattattagtggattaactccttcatcaattaacattttatgaagtttccaatcatttttagaaagaatttcaagatttgaaataaattcatcataaaactttaaatctttcattcttaaaatttcttctaatgttttataatgtgcaaaatataaagaatttatattttttacaaaacttgcatcgagtatttcttgttttatcatattcgctataagaaaatatgattcttgcgaagtcttttggagtaaataatgtttaaatatataaataatattatttttagttttgaatatttcttcttcatttgaatttaaaattaataaataatttataataagatttttattacatacttttgaaataaaagccgaatataaaaattgagaaacaagaagattaaatgaatctggaaattggttttcaaataaatctagagttaaatctactgtttgctttatattatcttcagtaatatcaaaaataattctttctattgtatgaattgtttggattgatggaagcattaaatataaatatcagcagtttagaattttttcaatacataccgatcataaccgctagattgaagaacttcaaaagtaaagattttatgtttatgcatctttttccagaaaacttgattgtttttttgtgaaaaatatttttacgataaaaagcggaagtgttctaataaaatatcgattatttatcgatttaaatttcgagcattaaatttatcataccccatcgaacaaaaaattgtcttattttcaatgaaaggaaacgattgatttaaaatctattaaaaaatattagctattcaacataaaaacaaaagttaagcttaagtttacataataaacggtctcatgtgaagtgagaagtcagatttgttgtaaaaaggtcaaattttccaattcaaaaaaaaaataattctatgaacctcaaattccttgctgctttcggtgatcatgttccactgtctcaattcaaaccagacgacaccatttccacacttgcattcagtcatgatggacaatttcttgcatcaggtgatcaagcaggaagggtggtagttttcaaacttacatattcaagcagtggtagaccaaccatttcgttttctaatcaaattcatgcacataaatcacagtttgattatttccgaagcgaaatcagcgagatgagagtaaattcattaaaatggattccacgacaaactattaatcctctccttatatcctgtaatagccatgatgccaaactatggcactttaattccacaccacgaattgcatggaacaccaaattaaaagacacatacatttttcccatgccacaacgtagcgatacaaagtacgcccccgaatgtattcgtactttcaatgatatccaaaccgagtacatcgtcgatcttcagacgttatcagatcaacggtcatttcttatggttgatgtaacgtgtgttaaattgtgggatattgaacgagatatcaaatctgtttgtctttgtaaaatatctcaacaagattccgaaatcactgcatctggtatacagccgaatcaatcatccactttcatggttggtaatgacggcggcttctgcaagatgtatgatcttcgtcaagaagcagaaaatctgatgccactttttgacataaacacatcaaaattttcaatacgccaacaattttcagacgaatgcagcatgattggaagtatatcattttcacgtgatggaaacaattttgtagtgcgacgctttaacgatttacaagtctgggatatacgtaatcttaattctccatgtgcgaaacttgaggttcaatggtttcctaatcagatggaatatcttttaagtgaggattatgtgaaagatcaatttcgaactgcgtttacggcgaaagataaaattgtgactggttgttattctgcggattatattgcttgggattggaaaagacaaaaagcgacaaagcataaggctgtaagcgcaagaaatcaaagactacctcctgagcctggtaaagattttaacaaaagagtaacagtgtgcgaggcacacccaagaagcgaaattgtcgcagtggtatcaacagcagcgctattcttctattatggtacggatgaataaacttttgttattatgagtaaaatttgaaatgtttgtgtaacttcaaaaataacaaagcgttaaaaagaattatgtgaacatatttcatttctggtgaaacgtcatatgctttaattgttggattagttttaggtggatgtccgagtaaattcaattgtgaaaaaaagtatagtttgctgttctgtattttatgcatacacgaaattgtgctctatttaattattgattaaaaacagggattaagtttaattagttttattaaagaaaacaaaatcatttttttgaaggaacgatatgatatcaagcacttttatggcgaccgttatcgagattttgggggttgtaacggttgtgtttggccttttactgatgtcaccaggtgtgggtatgaaaacaggaggccgtggctcatggcgccgcaaaacaaagaaaacacaaaagaacggaaatcaaaatggacttaaggtatggttggctgcacaacgtctcggatgccgtgaatttggtgaattagactcagcatcaatcatcctccaaggcagcgaagaagctctttccttccaaaagccagaacttgctttcaacatgcatgcaaatacatatgctatcatgggaaaggttgaaaagaaaccaattgttgaagttttaactgacctcatttcaggaatgaacctttctggacttaaggataagaaagaagaagaaaataatgatcttggcgatgttccagaagatgttgatttctcaaaggccgaagaagaaactaaaccagctactgagtaaacactaattaccatttttcaaacaagtttcgctcgttaatattttagatctatttgtcataaaaaaattttaaaagctttatttgttaattacatacgtaagtgatcggattaacatttctgaattaatgggaaaaaaataaagtttcgttagttttcattttcatttatttttttaattttattttgaatttgaattattatcacaataataagcatatcgatattgtctaaagaatgtatttgattgaataaataatttatttggaattggtttgtcgatttctgatgtgttggtttctttatctgacatatgatttgaaatatattttgcaatgccaacagactgagtcaattttgacttcaaggatgattcaaggaaacgttatcccaaaagctaggccaaatgacaagcgaagagcttaaatcaagaggaaatgcagcatttgcttcacaagactatgagctagcaatttcatattatacagaagcaatagcaattgatccactcaaccaaactctttattcaaatagaagtggagcttatttatctctccaaatgtatgataaagcaattgatgatgctagaaaaacaatagaattaaaaccagattgggctcgtggacacactcgtctcgctgcagctttagaagcaatcaaagattggaatggtgccgaagctgcttatttaaaagcacaacaactcgacccaacaaacaaccttattgccgaagatctcaaacgtgtacgtcaaaacaagaagccagcaccctctcctctaaatccgttattcccaccagatttaatagatcgtcttcgaatgaatcccttaatagctccgatgtttagtgatccttcttttgtcaaaatggttgaagacataaccacaaatccacaattttcagataaatatcaatcagatccacgactaattcttgtcattcgggcattacttgagcctcttcttaaccaagataaacaacaaacgcctccatcacccgcatcaaccactgaaaagttatcaggaaacagaaaagaagccgaagatgagaaaaacttaggaaatgccgactttagacgtggcgattatgatagcgccatggagcattacaacaaagcaatctccattgaccctacgaacatgatctattacacgaacatttcatcagttcacactaagcaaaaccgttttcttgatgcgatcgaaatttgtgagaaagccattcaaattgggcgcgatcacaacgcgagtaaagatatgatttctcgtgcgtatcaaaagattgctacaaatcaatcagctcttggtaacattgataaagcaattgaagcgcttgaaatgtcacttcaagaaaaagaatctcgagaaattgaacgcgagaaagaacgacttgaacaaatacttaaagcattaacaaaagaaaatgatgaatcatatgaacaatatcaagaaaaaggtatcgatgaagaaaagaaagggaacgttatcgatgcaattgacaactttacaaaggcgattaataacggcgacaaaaacgaagatgttttcataagaagagctgacttgtttgtgaagataggagagtttaagagatgtttaagtgattatgaaagtgtaatagaaatgaatccaagcgctgaaatgctaaggaaaaaagcaaattgtttgttctttatgggagaattcgaaaagacaaaagagttttaccaaaaggcaatcgaagcggacccggaagatatggctattcaggaagaaatggagagagcggtgcaacaaataaataagctgaaaaccccgataattataccgtgtaatgagtttcatgatgcgccaaataactcagaagaaaaatgtgaataaaaaagttaaatgttataaaataaatgcatttctaagtctgtagtggtttaaattaatatgttgaagtcgatgaattgattattaaaatgtttaacaacatttttctatgatgactttttaagttcaaattaatgtgtgatacatattttgagatgaaagaagcattagatttataagtttaaaacagctattataaagtctgatgtttctacatatgtatgatgttaatgcaaaaaatattcatttgaataattttgaatatgttttaataatttgaaacagcacttcatatagcagttagaaataataatatagaaatagtaaaattacttttagataaaggaattgatgttaatacaaaaactatttatttgaataattttggatatcttttaataatttaatatactgttgtacttgggggatacttgtttacgtattcagatgaagattgtaattactaatcactttatcacgatgaattttgtacgccatattttgcaatcatcgaaaaaatatctttgaaagccacatatacaaatttatataaaagaaacgttcaacataaataattaatttctttattctttcttcttttgcactttccgaatcctatcaattctttgtgccaacgttggatggtttgcattgaatgccaaataaattgggtctgtatcgacaattgccttattttcctggcacagtttcaacaatgcgtcgtcgattttcaggcccatttttgcagagtattcatctgcttgatactcaaacatacaactaatcaaattcaatcccatgttagacaactcatacacaggcacaacgaagaacgacacaagttgtattccaattatgaaaggtttctcatcgacgaaaccgaaactttggaatattgaatcactttgcattactttaacgaaagataacaaagtcaaaagattcgatatttgtgaaataaataataacttaaggatatggcgatgttttgaatgcccaatttcatgtccaataattgcagcgacatcatcaggtgtaccatttgttaaaacagtatcagcaattgcaaccttgtgcttaaacataccaaacataaaggcgttttgcttggtgctgcgcttggaatcatccgcttggtatatctcgcttaagttgaacgatgaatcagctgcaactttagtaacggcttctttgatggggccatcttcgagtggagtcagctttgtaaacaatggcatgataataatgggatataacacttgaacaataataacaaagacgaaaagaaatactaaacttatgtatatgaaatagatacttgataatttatagataaacgataaaactgaataaagaatagattgaagaataaaggatacaagaaaactcttgatggtgtcagaaacaaaaagtgagacagtggacttgttaaagccatatttttcatcaataacaaactttttataataacgtaatgggatttcaaaaatagtagagagaatcgtggtggctaaaataaaaagtggaaggtgtatgatttcaaggataaatcttgtaaatgtccaaaatttatgtaaattaagaagaattagtacatttggtattaggcctacaaattcacttacaacagaaaacttcatgcaaactgtttcgtattcctttgatttttcaaattcatcaaaggtgacttctttgcgatatatttctggcggtgatttttgtttcttgataaatgaaagctggcggtaattaagatatactttaaatagtgtttctaatatgagaattaaaagtccaattgcttcaaaactctccattttttgtggtcttcaagacagaagaaaaccgttatttctttatcaaaattttcaatgaataaaattcccgaccagttactgattcaaaatacttgatctggtagacactttttaataaataattcatttccagctcacatcacccttgtttttgacataactgccatttttctttcaaaatccactttttgaaaaccactttttgttgattaggcattttttatgaataggcaaattacctatgaagattaattcacacctctttaagttagctactccacacttagtttgtaaagtcatttcttttcaaacatcgatttgatcaatatttagttcaaccaattatagctggacttgaaccaggtacaaataatccatcagatagtattggtgctatgatagaaccgaatgattttgctgttgcaggaacatcaagtgattcattgtatggtatttgtgaaagtctttggaggccaggaatgaatcctgatgagttatttaaaacaatttcaacatgtttgatatcagctatcgaacgcgatggactcagtggttggggtggaattgtttatattgtaacaccagaacaaaaaattacgaaagaaatcaaaacacgtctggtataaacaattcatttctttggtaataatttaatgtttacacattactgattagattgtctttaagaagggcaaaaagtctcatcagatctaatctcaaaaagtaaagtgtttatctaatatgacatattagaaaaatattttactaattcattaaaatatattgtccttcgggatagctaatgcttggtcatagtccatactttgtcttgtacgcttctaacgctttctgaatgatctttcttgcttgacttcattattgataatgggggaactgataattggcaaagaaccagaatatccaacggatcattatcttctgctaaagattgaggaacaaacccatagtttgctggatagattacacggtgaatgctgaagctctatccaactttcaaaataatcctgattgtttatcaagctctgtttaattctagacaaagtagatttcagtacagctcgaatttcatcattgttaaggcctttatatggaacagcatgcctggatgtatgctgttccataaaaccttaacgatgatgaaatttcgagctgcaggatgactgaagttgaagtagggtcgataatctatccaagcaaactgagtttgttcgcgaagatattaaccttgatatcgattcccccgtatcaacaatgaagtgacgtgtaatgagtacgatagtggctgctaaattttgactgaatataagcatgttatgatatctcgggaattacctcctttcagattattaatgataggtaattcttccaacgttacaactttggaagaaagaggatgaacattcaagctgctgaatgtcgaagcagaagatttcgaagcacgtagaagcgcggcaaggcgtggactatattgaagcgtgcttatcccgaaagacaatattttaatagtgtaaatatattttctaatgtaatcgcaatagataaacgctgctttactaatgcaagaaattctacttggaaatatgttttaataattgacctgttcgatgtggatttattttaatgatttagaatatttttgtaatatttgacaccaattagttgtcgcagaattatacgatgaaaattttgcgcttcttagacaatctagtattggtaatgtaaacattaaattattaccaaagaaatggtattttccagacgtgttgttctttcgtattttgttctggtgacaccttctgccaaccactgagtccatcgcgttcgtgctgatatcaagcatgttagagtgtttaaacctttcatcaggattcctggcctcaagactttttgcaaataccacaatccttattgttcctgcaacagcaaaatccttcggttcctataatactatctgatgaattgtaccagactttccagagtccagcaaaagaggaatagtgggtatcttcataggtaatttgtgactataaaatgcctaatcagcaaagaatgattttcaaggtggttttgaaaatggcagttatgtcaaaaacaagtgatattggctgaaatgagtatttattaaagtgtctgccagatcaatgacctgagtaactggtgaaatttattcattgagaacacgacaaaagaaaattaacggttttcttgtcttgaaccacaaaaaatggaggatttgaaagcagtgaacagtctcatattaaaacgctatttaaagtatatcttaattaccgccagctttctttatcagaaagcaaaaaccaagaaaaatagtcactgataatttgaatcaagggaatacaggcacagttgcatgaaagattttgttgtagtaattttgagcctaatatgatgtactattgtgtattacatcaaattttcagacattgcaaaagatttgtcgcgaaatcgccgccttccactttgttgcctgcattctctccccatacgtgtataaaaagtttgttattgatgaaaaatgtaggcgcaacaagtcactgtctcactgtttctgacaccatcagaggcactgctagtatcctttgcttcttcaatctattctttattccagttttatcatttatctataaattatcaagtatctgtcatatacatggttagtatttctttcgtctttgttgtgtgttcagagatgttatatcattgtgccattacaagctgatacactcaaaccacgtcaaaagaagccacaaagttgcagctgattcatgttcagcaagcgggctatgcaagcggatgttccaagctgcagcataagcgcaagcgcctttgtatatttaagcacaggttacgagctagatactgttttaacaaatggtacgcctgttgtgtcgctgcagtattggacgtgaaaccgggcattcatatcgccgctatcataagttattatttatttcacaaatatcgaatcttttgactttgatatctttttcgttaagtatgcaaagtattcagtattccaaagtttcgagtttcgtcgatgaaacctttcatattggagtgcaacggtctcgttattttgtatgttgtctagcgtaaggattaatttgattagttgcttgtgtttggtaacccagtagatggtctctgcaaaaatggtacgaaaatcgacgacgcattgttgaaaacatgccgaaatggagcagtatcggctctgagctgttgtggcattcagctgcaaaccatcaacgttggcacctcaagaaaacggtaaggattcgaagtaaaaaaagaagaaagggcaaagaaaattaattatttatgttgaacatttctttatataaatttaactgtatgcttttcaggctatttttcgatgaaccatatggcattaaatcgtgacaagtgatgtattacaatctttaaacaatgcagctgtgtatcccccaagtacaacagtataaccagtaagatatcaagtattcaaataaactgtattaacatcaattcctttatctgagtaatttacactatttctatattattatttctaactgcgagatgctatttcaccaaaacataataaaagtattcaaatattttgcattaacatacatatgtaagaaacatccgggcactttataataactgtttttaaacacaaatctcttcaactaatcataaagtgtatctttgtctattgaacaaaagatcatcagaaaagtggtgatattacatcgtcgataatgaacgacatattaattgatactgtttaaaatacatattctaacatttaacttttattcacattttcttctgattattgacatcttcatttcatcactaatgtagtatatcgagttttcgactttattattgccagctctctcattaatatgaatacttctatctttcacagatcctttgatgcttcagtaaaatatttatctttttagttatataaagataaacaattgtacctctgtggcctaacgctttaattcttctaatgcgctttcgcgtcgccagcatgtaaaactatacctcaacgcaagccaaatcaaactcatgcgaaagcatcgctcgttttatcgcattatcaatacacaaggttatcgatatcgacaacaattccctttctttctttgcatcgacctttcttgataatgttgcgaactatcggcactgtgtctttaaattgttgatgttactatgttcatttcagatgctttcttgagtgacgctcaacgcttccgaaattgtatccaaatattgcaagctgttgttaccgctaatctgccgactgcacagaaaatcttatcgctatccatgtgttgtgatcgcgcggctgaatggcttctctgggatttcgatcgcatcaagcagttttgcttagtgtgaactgtcttcgtgtggcattcgctgggaatggaagattgctttgttatgtgctccatggccttcatatctgtttcctagggttttctcatcttcggctcttttctgtttccaccagctttcagtggttgtgcagtgataggcatttgttgatcgtagttaggagctcaagctgcccgaatgacaaattagtcgtggatctgatgatcttctcacgaaattgtggatttgtggttatgtcttcaaccggcctgacaaaaaatatcgattaacaaagagattcattcgaagacgatatctattaaatctggtgaataacagatttaggaggaggagtgctaatgtgtgcgttgaatcttcggcaatagtgcttttaaataagcggcttcggcaccattatctttcggtgctctaaactgcggcggtgaagcaatattttaattctattgtttttctagcatcatcaatgcacatctacgactggaagacaaacaagctccgcttcctatttgaatgagagtttggacggggtgtgctgcttctgtataatatgagaattgctttagccatagtctcttgtgagcaaatactccctacggtaaactcttcatgtcattgaactagcactaagtgatcatccttgaagtcagagtgatctgttaacgaccaaactatatttcaagtcatgtgtcgaatgaaaccaacacgtcgaaaatcattggaaaccatttattcaatcgaagctcattctttgtttaataatcgatatgcttattattgtgataatattcaagaaagcaaacaaaaaatgaaaagtaactgagcttattttcccattagtaagaaatgttaatccgatctttccagcataaattttttatattgaaacagataaaataattggcgagcgaagctgactgaaaatggtaattatgttttcagccaactggttcttctcattgctgaatcaacctcttcctggagacatcgccagatcgtgtaacactgtatccttaagtcccagaaaattcattcctagtgagtcgattaaaacttcagcaatggtttctttcagctttccctcaatatgttttgcatgcgc

SEQ ID NO: 28 - DNA, 221339 bp, Histomonas meleagridis
  misc_feature: contig_72_vir
acaaacgaccaatgagaatcttattcacagatggtagtactaaaacattattattagatattactaagaaaattgaagaaattacaccaatacttttcgaaaaattagcattacctaatattgcaggttatacactttattcattagaagatgaaaagaatcctcgaccattagatacaagattctctatccctgaacaatgtacaacttatgatcaattattattcaaacgtagattttatattttatctggtgaagtacttcaaacttctaaagctatttttactacacttaatgattgtcgagaaaaattaatagatccaaatggacttgttagaattagtgaagaacaagcaattgaattagcaattctctttttatatggtacagctaaagatccaaatgaaattaaacaaagaaaagtatttgaatttgatcaattaatacctccatatattaaagttgataagaaatttgaagctaaatttaagaaatcatttgaacaatatcctccaacagaaagaattattgctgctaaactttatttaggtatggtacgtaaattaccaggttttggtgaagaaagattccaaggtttaatgacagaagttacacaaggagtaaattctcgaacttatggtgcaacattagctataggtccaatgacaatttatattatattagcaaatcaaaaaagaaccactttatgctattacttatagatttattgtagggttttcaatcaatgggtcataaacttgtattaaaatttgttaattctaagacatcaaagattatatcaattgaattcaaattaagagaaattgatacagtattaatgttattaaattataacattaaaattattcgtgatttaatgcttgctaaacaaagagaacaaagaaaagaacaagaagatacaattaaaaagattacgtggtggatttgttgatgaaaacggtattgttcgtcaagcaatgcttgattttttatgtttcttctgatttagaaaagagagttaatttaccaaaggtttggttagaaactattcgaacaggtaaagaagtagcagatacacttgtaccaattatgaaacttgatcctaagattgaatatgcaatattattatggatattaaaggaatcttataaatgggtattaaatgatcaaactttagcatctgctaatccttatcgtggtacaatattatttgtaattgaagcatttccaagaattaaaatttatttctcaatgggtaaaactaaagtaatgatattaccaattgttaaaaaagttgaagaacttattccaatcgtagctaaaggtaatggtttagcacattatttaggttttaccttatatttaccttctaaagatggacaaccacctaaacctttagatacaaatatctcaatacctgaacaagctacacgttattctgaattagaatttagaagaagatttttcattattacaaaatccgaacttgaagatccagtatcattatatcaagcattttgtgatgttcgtgaattaatattatcaggtagattagcattaagtcaagataatgcattagaattaatgtattatgctttagtagctgatggtcctacagtattaacacctacaactataccaaatgaaaatagttttccagcatatttacctgttaatatgaaagttaattataagacaggtaaaaataagatcaatgaattcttaaatactataccagttgaaggtaaaattaatgcaatgattaaatatatacaaaaggctcgttcattaccacaatttggttgtgaagaatttcaagttattcttgttgaagaaaagaatggacatactacaagaactaatgttatcctattttgtggaccttataaagtatttgttatggatgaaaatagaaagaatgtattagttaatgtgccatatcaaaaattcattaaacttgaaacatttggtattgaattatcaattaaatattgtacagaagaatttacagcaggttattgtaacattgaatctgaacgagcagaagaaattgcttcattaattttaagttatttgaatcttcaaaaaaaaaatattaatgcaaaagattcaagatatcgatgaaaatccaggtgcacatggaggagaagtgattacaggcgtttgtcaagactgtgataatgcacaaagacatcgttatgataaaagagatacaggtaaagaagttatacgtaaaagcttgtcaattcttaggattagatccaacaggtcaatattcagcattacttagaatttcggatgatgatttccgttgggttacagatgatgtagtattaggtgcattaaatccatttgatggagttacaattcatttatattatacttatatgccagttcaaattcatacagatacatttgatcgtgaaatgttaattaatgttgagaaaactgtatatcaattaattaatgaaattgcttttaagatgtatgttgatttcccattaggttatacattatatgctagagatgaaactggtgaattcccattagatttagctttaacagtaccagaacaagttttagatttcgataagatgacatttagaagaagagctttattattcactaaagatgatattatttcaccttatacatcagaacaattatatcctgatgtagttagaagtgtattaagtggtataccagatgttaatgataataatgctattgaattagctgtttatcatgcattaacactttatccttcaccagaagaagctgctaatatacaaattgataatattgctgaacttttaccatcaaattataaacttaaacataaaatatttaataagattaaagaacttattacaagttattcaggtcaattcttacaacatcaagcaattatgaaatatatctttactgctcgaatgttaaatcattttggttgtgaaatttattctggtaaacttgaagaaaaatctgaggttgattcaaaatctgctaaaaaacaaaagaaattattacgtgtaaatattgcaataggaccctttaggtgtacatatttatgatccaagtactcaaactgattatgctaaaatagattataagaatgtagttagtgcaacactaattaaaaataaattattccttcatgttactgaagaaggtggttcaactcaaacattaataattgaatctcaaagttcaattaaaattagttaaattattagattcttataagaaattctggcttccaggtttagaacgaacatgatatgatacaaaaaaatctagaagtagtgcagaaatgtatagtagtattagaaaaagaatcaaaataatgcaatgccaatttatgttgaaagacaattagatcatccatctccaaatatatatcaaatttctaaagatttaactccagttgaacttgctaaaagtaggtttatatgatttaacaattcaacataagaaagcttatatattaatggtagcaaatcaaagaaagaaatttgaaaaaagataatgattataaatttgattgaacagtgatcaaacattagcatcagtttcacctgtaaatgaagcacatttatttgtagtagaatatagcaccagttgttcaagtaattactacaattcatagagtagcagaacttgaattagaaattaaagttgatatctttacacaatgtcaaaggttagcaaattatttcaatttgggttcacatttagcttatacattatatgaagtatgaagaggtgaaagaagaccattagatttcaaatataatatacttttaactacaccaaattatgtagaagtattacttaaacgtagattcttattattctcaatgaatttattacgtaattatcaaacattattaaatggttataaagatgttaaacaaatggctttatcaggtataatgacaatgactgaagaacaagcatttgaattagctatattaagtttatatgcagaatcttctcaacaatcagaagtatcaattcaagcaaataaaatgacaattgaagaattaacacaattattaccaaagaatattacatgttcatgatgatacattacgaagatttaaagcagcagcaaattcagttgtaccaatgttaccaattaattctatggttcgttatattatattagctaataatttagtaggttatggatcagaaacttataaatgttattatactgatattattaatgtcaacaagaaagctagaagagaatgtactatatcattatcaccttataatattactattaatggagtacaaaaacaaaaacaatattgtattatttattggcctaaattaaattcttatcttagacatgaagatactgttgaattaacatttaatgatgaaaatggtatttattgtgatattgaaatagaatcagaagaacattcacgagaaatttattcatttattaatgatttaatagaattacttaatatgccagaatttagagatttccctaatttcttagatatagcattagatgatattaatgaaggttatgatgatatattaaatatgttagatcgtaatgctttattaaatgatactgatgtaaatccagcagattcatttgatgacttaaatacacaatatgatgataaattatttaataagaaagaagataatattgattggagattactttctgatgctttaatgtataaacgtggtgatggtttattagatgctttattagatcaattaaatattatgagtgatggattaaatacttctgatcctaatgatttatatggtcaacttaactttttacatgatcaattaaaacaatatttagatggttgtgatgatgaaactaaacaaatcttcttacctttattagattcacttgattcattacgtaaaagattccaagatatagcaggtaatgatttagatattactccttatataggtgaaattagaagtaaaattaatgaacttaaagctgctattgaaccagctaaaaagaaattagaattagctttatcttcattagatattaaacttaggaattcatttgtttctactgatgcaggttcagtaataccagtaagagtttcacctttaagagaagatcaatgtttagctaatgcattattaaatatttctgatttacaagaaattttagtgacacaattacaaaagaattatccattatatgctaaattccttgataatcctaatcaattaacaaaacaattattaatgtcttcttctacattaacacaaatagcttctaatttattaaaagctaatggtaatccagaaatgatgcgtaaacatttaattcctcaattaaatgatatcttaaaacaattaaatgcagttggtaatgttattactaaagctaaagaaaaaggtattaatattccagaaatagaaaacttatatcatgatttaattggaaaaattgaatcattattaaaatcagatgtattaaataattataaacaagatagaactacacaattctatcaattttatccaggtgatcatcgattattagaaaaggcaatacaaatacttcaaaataatgtaataacttcatcacaattaatgaatgatcaacaaatagcttctaataaatcgataacttcttatttacgtcctaaagtagaagaattagatcatgattctcaatcattacaaatagcatttgaaaacttaaatatcgatgcattaaatgatggtaatcgtacacaagcaattgaagcattacaaaatacattacaaaattatcaattattagaacaacaattttctaaaatgtctaatgtcccattaggtttaacaagtttcatccaaaaacttcaacaagatgtacctgaattaactaaaatcttatattcattaagtacagttaatattacaccacaaaatgttcaacgtgtatccgatgatttaactacaatttggaatcgttatgcttcattaccaccagaaattatattaaaacttacagataatcaacgtacttcattaggtcattcagtaggaaaaattaaagatgtcttaaatactattgataaaatattaccaaactttatgaataatcctacaagtggtcaatgtgtatatagtgcacaacaatcaatattaaaagttcatgatttattacctgaaattcatagttttgttaatcaattaagtgatataactaatgatcctacttatcctgttttatatgaacgtttaattactaatgttaaatctactttaagtgaacaacctttatcagaagaattttcacatctaaatcatttaaagaaattccaacaacttcaaggagaaactgcacgtgtacttaatttaatggctattagttctgagaatccttatattaaaattaataaagaattacatgaaaaacttgaattccaagctacacaattaaagacaaattatttaactcaagttcaaactagagatgaattacatgaaagaccttttgctaatgaaaatattttaagtgctgtaaatgtagtaaataaacttcaacaaattgttgaacgtattcaacctacatcacgtaaagtatctgatttaactaataatttacaacttgaacaaatgactaatcatttattaacttcggctatcgatgcattaaatgctataagaaaagctaaatgtgaaccatttagaagattacctacacaaaatatggtaaatgcattagaaaaagctttagatggattccaacaatcattacaagaattagagaaattaccagaaatatcacaaaatgaaaatttgaagagtatctttggtaaatatattacattaaatgatgaaatagataaagaattacgtgctatggctactaaacctaatatgaatttatataaacttgcatctaaacttgaaaaagaacttattcaaatcacaccaacattatcacaagttcaagcatttaaagctaataagaaacatcaagatcgacttaatgaattatctaatgtattaggtgaaacattacaagaaattattcctacatttgaagattgtaagaatttaatacgtaattatgtcccaatattaaatgaatgttcaaatgtatttaaaggacatttaaataatcctaaagttaaacaaaatcaaatagcttcaactatactaaatgattgggtagataatgctataacttcatataatgtattaatggaacatttgaatgatcctaaatatggtattcaacatgctacagaagataaaaacataatgttaaagttattagataaatatgcacaaattcctccagatcttagacaatgtttaacacctaaagaaattgaagatttagctaaattattaggtcgattagcagaatctgctcataatgctattaatggtattagacaattaccaggattaaagagacctaagagtgatccatcacaatttgctaagattgaagctattgaagaattatcagaatcaatacctaaacttggtaaacaaattgaatcattacgtcaattctataaagaattagttgatactaatacattatatgatagacctaatgcacttaaacttacaacagaaattgaacaacaattaggtttagttaaaatagatcaatttaaaccagatgcagatgaaaatcaattaatgaaaactttatcagacttaaaagaaaaaatgaattttgtaatatcttcatcagaattaatttcacctattattcatgatccttatatcggacgtaatacacgtatagttaatgataatattaatactatattacatatattagaaaatccacatcttaatcttaatacttctaaagaatttgttgatacagtattaccaatgcttaagaagattcaacctcaatcacatgaatttattaaacgtcaagatgttctatctaatcaagcattattagattattctaaaactttagatactacaattgataaatctatagttatattaccagaatcaattgataaacctcgtaaattacaaatgacacttgatgaattatatcaatctacttcattattaataccattattacaagaaaatccagatcatgaaagttatttacaagctgttaataaattatttgatttattaaatgattatacttcattacagaaagtagaaattagatattctgatgctattaaacttaagaaaccaatattatctgataaacaagttaaagaattagcagatcaaacatttagtgcatttgaatctagaaataatgaagttgaaccagaattatttgaaaatcttactgataatttaggatttattaatgatcatcaagaacaagttccagtatatatttctcatgctgctttattaattactccttcaatgcaaactcatgaattagttcgattatctgattctttaagaacagtaatttcttgttcttctgaaggtttagctaatgatctttatgagaaattagctgttaaaacttctgttagagcagcattacaattaatacaattagaaaaatcattagaattcttagaacaaagagttgaacaattttcgaatatgtttgatgatgaaactaagttttatttagctaaattacaaaatgctattaaacgttcagatacttcattaatattacaatgccaatcattacctacagcagtctttaattatcaaccattacataatattgatgattcattacaattattattaaagaaagtttcaaatattgctgctattaaacctattgtacaacctttacaagattgtggtaaagattttagtgattgggtattccaaacagatttatctatgatggcttatttccaaaatcatatagatgatatagtatctaaaacagaagatttaatatctaaagataaatctcataaattacctgctgctttatctggttttgtacgtcaagcagtatcaaatcttaagtttaaagaaagaggtatttcttatgatatgcctacaattaaacaattatctaatttaataattaattatcaatcagatttatatccacaaatattaaaagctttaccagaatcagatgatactaaacaacttcaaaatcatattcaagcattagaaaagattaaaccaattattaaatattggcaaagtccaatacaaaatcttactaatcaaggattacgttctaatgtaatttcttcattatgtacttctattaaatctacaaataatattaagaatactaatgaaaataatcctgaagaaatacctttagattttgctttaggtagtgctaaaatttcttctttattacaaaacttaactgatgctatagataagaatataccagttaaagaagttcatgaaaaatctattaaatcttcagaattagctaaaagtattattgatagtaaaaatccatcacaaactaaaatagatattgaatcattaataaattgtttaacacaatcagaagaattaataaataaagttataccaatcgattataatagtattgatgaaatcgataaaatatcagatttagaatcattatttagtatgatttctgataaagaagcattaaacttagttaaagaagcagctaaatatttagagaaattaatagcttcaatacctaaattaagtaatgaacaacgttcttcagatactaataaatttaatactaaattagatattaaattatcaaatggtaaaacaatgcaattacctaaacattcacttcattcaagtaatattgatcaatcattaaatgatccaataatatcagttgatcctaaagaatatgatgaattattaaataaattagaagatttaatatatttaacagatgaacctactactgataaacaaaattctacaatagcacaaatagaacgtacaatgttatcacaacgtatatcacaattacaacaacaacaaatctcagaattcccagatgtagttaaaaatatttcatcaattaattctaaagtattaccaattactaatattacttcagatcaagcaagttcttctattaattctattcaacaacaatttgaagcattacaatcatcatcagaattacataaattacaatcacgtttatcaccagatcaaatattatcacaacaattattattaacacataatttaactcaagctatcgatcgtaatgttgatttaccaattcaatcacatgtcgaacaaactaatgctattcaacaacaattatttaaatctataatggataaacttcaaacaggtaatttaccaaatacttcaattaaatctgatgatttatctgcttcaattcaaagaggttattcacaattagcattaattaatgaattaattactattcaacaacaattatcagttaatattccagatttatttaaatttgtacaatcaccagaaggtttacaattacttagttcaccaattacaccacatcaattattagaacaacaacaaaatattcttaaacaagttaatttagtatcttcaccagaattattaaatgcattccaaaagaatttattaccagaacaaattattattcaacaaaggattttacaacattcattaaagttattaactggtgaatttggtcaatctttaatgtcatctgaatctggtaaagatgatgtatctaaaacagctatttttgcttcattaaattctttacaacaagaaattattaaagaaaatccagaagtcttaaagttaaattattatgttaatccttctgatatattagaagcacaacaattttcttatgatttacttaatagattaacttgtatgcaaaagatttctgatattcaacaaaaacaattaactacaaataagaatgcagctcaaattatacctaaattaaatcaacctactaatagtaatatattaaatgctagacaaatatctatgcaaagtaaatcattaattacacaatttaatgatccaactaaaatattacaacttactcaacaactttcagctcaagaattattagaacaacaacaaatattatcagcaattaaatctattttaactaatccagaattacttaataaatattgtccaggtattaataaatcaattgacttaaatagtaaaatgaatcaattatttaatcaattacaagatcaacaaaataatttacttagaaagactactaaacctttagatggtattaaaccacttatcgattcacaaattatgaatggttatgaaaagactaattctaaattaactaatcttaatcgtattgaacaagttaaaactttacttaaaacatttaatactataacacctgatttatcgaaacaaatattaacagctaaacctacattttcatcagaacaacttgaaactacacgagcaattttagaaagattaattgaattatcttctagtaatttatctaatgttacagatttaattaataatttaactaaagatgatcaaaaacgtgtatattcattattagttaaagaagtttctaaattaaataaattcgatccttatatagcagaattattacaaaaacaatcacgtatatttgatatggctgcaatcattcaacgtcaaccaggtataggtatagtatctgtgtctacaaaagatttaccacaaatcgaaaaagcagatcaaattgaaaagaaagttaaatcacttcaagaaaatattatagttaaaggtgttcaaaataaacttattaaattaatggaagcacgtaatgacttaaatccaatgttagcatcaattacagatgaagataagaataatgcacttaagaatattacagctaatgatgtacctaagtttagttcttctttaattcaacaagttaaagtcttaaatgataattctaaattaaataatattttagaacatactaataaagatcaattaatagtagaacaagtaatgttacaacaaataattactgatgaatctaaagaaagtaaagatgctaaattaaatggtattaaattagttaatgttacaaattcattacaaactacaattattaaatctactgaacaagctatagaacatcaaaagcctacattagtatcttcaattcaagtattaacacctattaaacctttaactaatactaaaattaaaacagcatctaaattatcagatgaacaatttgctcgtacttgtttaacagagaaattagaaaatattaaattaaaacaacttaaaggtattaaaggtttagatgaatttgttcataatacttctacatatgaaacagctacatcagatccatttacacaagatgaagttattgattatcaagatatgcttaagtcattaattacaattgatgctaaagcagaagatgttttacaaacttatcaaaaacaaactaaagaaacgaatactagaggacttacagtattaactaatttaacagatactattacacctaaagatattaatatagttacagaattagaaaaagataatttaacagatgaacttaaatcattctttgataaatcaattaattatgatgatttaattattggacaagtaatggatgttaaaatcccaagtgagaaacaaaatgcttcaagagtagcatcagcttatcaaggattaattactatagtccctacaatgtataatattccatcagaagaagttaaatctattttaatagcagaaaataaagaagcattaaatattgttaatcaaatttatgattctaaatctacttcttattctaatcaaatccgtaaattagtagaaattgctccacaacttgtagcttcttattctagagtttcttcatcacttaaacctcaagttaaatctcaacttaaattaaatccattaaacattatgtcatcaattgaagcattacaaaacgcttcttgtgttaaatctacacaagaaacagcttctaactttaggaaattattagcagatttatattctacattccaaaatattgattcagctatagttgaaaataaagatgaaaatccaatatcttcaacagtaaattgttttgcttcaatggctaaagctatacaaaatcaagatattgatttaatgaacaaagaaattattcaattcaaaggattaaatattcattcattatcatttggtactaatgattcatatcttaaagctatggaacctaaaattaataagatattaccattagttgaaaaatcttatgcaattcatggtaagattagtcctgaattattaaagtcattaacagaacttcgaacagatttaattacaatcattaataaagaaactaagaatccttatgaattaattgaaaaacttaagacagctacagatgtccaaaaagttatttctaattctatgcaaaagattggtgtatctacaaagaatttaattgaatcagtccaaaatagaaataaatcatctaaaactcaagcaattgcagaaatcattgaatatgtctctaattctatagcagctatattccaaggattaaatgttacatcatgtgaaaatgattcgatttataatgattgtattagaatattcgattcttctttaatatcagtacgttcaatgattgatatccttaagacttctgcagtttcttctacttctattcgtagatctacacgttcatttaatagaatgtttgattcgatgcttgatattatggaagatactaatatcccaatttataaacaaaaagcctacatcagatatcggtaaatctaaattagaattcatgagaattgcttctgatgtaattaaatcattatcttcaactattacagctagagcagaatctaaaatccccgaaacatttgaaataatgttcaattcacaagtcgaaaaattagagaaatctatgaaagaattagaaactaaatcaactaaattattacaattaaatactgataaacaagcagagaaagaatttaataatttatttgttactattaaagaacaatttggacaattcaaagctaatgctaaaaatccaacattaaacaaacaagattcggcattatttgatttaactcatgacttcattaacttaagtgattcatttggtgggttaacacgtgttattaataagttaactgatgctgtacctatagtacctgatttagaaaatgccgaaaaacttaagaaacgttatgtaatgccatcagtacctaaagacactgctaatttgaaagttattgattcagttaagaagttaaatgaatatattaatatttatcaacaaaagtctaaagcattttatggattattccctaatgcaaagaatgcacaattagcagattcaatgaacgaagtatatacagctatagataatgtcgtattacaaacattaagagtttcagctatatcgatgaacttagaattgcaaagtggtttagcaactacttgtagtaacattgcagtaaattatgattcattacttaaggaattacgtagtagattcatgttaagtggtgattgggatggacaatcaccgaaatatagagaaaacattaagaacgcaattgaagagacacagaaaatcgcgcaaaaggcattagaaatagccgaagaagaagctaaagcacaaaatgcagttaacgctaagttcactaatgtattaaatccattaacacaagttaaatcatcattagaaacttataatgataaagtcaagacaatgaagtcaagtatctcacgtgaatatgctacaaacatgttaggaattggtatcactttatgcgactctgtaaatcatgttgtgttacatgcgaaggcacatccaagtagtgaagaaagcgtcgatagttatctttcattaactgaagaagtaactgaacaaatgaaattattactcgacgcgtcaactaaaattacttcacaagaaaagaaagtcgaagaacccgaaactttagtcatcgacagaatgaaaggattaaatggaatcggagagaaattcgcaaagccgcataacaatgagtcacctgaagcaaaggcactgagagaaggcgtagtggtaatatgtaaaggtgcaaacgcattagcaaactccgcagaaactgctttgaacaataagagagaacaaaggaagaaacaagaagaagctgcaaagaagggcggcgctgtcgtgagagttggaacaacaaaggaaagtttgctcaagagattggagctcgagtcaagagtcattagagcacgtatcatactcgagaagtctgagaagaatctcgctgaacttggatgaaatgaggagaaaatttaactaaaaaattaattaaaattactgtgatgttttatacagaagaatatggaaacatttgaaaagatcgaatgcgtcctcatgtaattacttctttaatataaacttcgcaagcaaatatattattctggacatgagtttccaaatatttggtgtgaaacttgtataatttacatggagaaaaacgacaaaaagtgcaaacgttgtacagttgtgtaatgctttgaaatgatgctgtaaacagctgccgatggatttttctatagaacgataatgaatttttgagtgaaaaagttttcttgcattgaattaccttatttacagtttggacaatcctggtgtttctgtttttcttcctttctctaactgaaattactcgtttcagtacttggtgtaatggcatttcaacaggagattgcgaaactgaactccaacaaacagataatgaattttctttttcacatattggtgaaaaagattattctgttacatcacctcgtatctcatggcatcctggtgatgaagtaactgttactggcgatgttttttatataaaaggagatgctaaatttcaaatcattccatacgattttaataatgaaccagattggtcatttcaatcttatccagttgttgattcacctggcgaatatactacatatactagaaaatggattattccaggaaattcacgtaatttcacatttcgttttgtcggaagtaatattaccaattttaagtttaaatctataaagtgggatataactggtcactacgatgcacccacaattcgaaatgtcgaacttgaaaattcaaacatcaaattaacatatgatactcttttattaaatatgacaatttatgataaaaccactcaacgaacttgactcaacgtagacaaactattggtggcactacaataaatttaaaaacgaccagtagttcaatttctattgatacaattacacccagataatcttattcactttaatattgaactttttagaggatggatttcgatctacagttgctcttgataacaatgactccgaaattcttccaccagattatccgtttccatttatctcttcacttggagatcgtattgtacttccatactgtgaaggcatcacacttcctgttgatttaaccgaacttcttggacgtgatgaattttattatagtatttatagtttatcaatgggatttgttggtcaaacaaatgatcaaagttcaatgataataatatttgaaacgccttatgatagttcagtagccgttgtccgttataatgaagaatatttatatattaaaccacgatttagtcttgagaaaggccgtttttcatatcctcgaaaacttcgttatgtctttttagaaggaaatcatgtttctatagccaaaagatatcgaaaatatgcgcaagaaaaaggatatttagtaccatttacagagaaaattaaaactcgtccaaacgttgataaattaattggcgcagttaatgtatggactgttggtagttttaatattaataaaatcaaattatataccgaaatgcaatcgttaggaatcgaacgaatattatcatcaggtggaggatcaatcagtgaagttaattatatgaataataatatgactaatatcctttcaagtcgatatgatatttatcaagatcaaatggatcccgaaaatattatcaaaggttatgtaagtaattcgacagcatatttttatgatgcatttcctgatgatgttattgttgatgaaaataatcaaataattacttcatggtcagtaaataatttatcatgtccagcaggttcaacacttgaagaatgtccacgagttggttgtccagtattatgtgacttaagagcgcctgaatatgcaaagaagaaacttgataaagaaatttcttctggttataacttcacaacacgatttattgatacgacatttgcatcaccttatcgtgaatgttatcatccagatcatcctatgactcgaacaatgtcattagaagcacgaatcgaacttttaaaggaatatacaaatcgtggatttgttgtaggaacagagaatggtaaagaacaagctatacctaattgcgatttctttgaaggaatgatgagtcctggcgaatatagagtacctaactctggaagagatttagaaacagtgtttacttatgttcctgaagaaactcaatatatggttgatgaaactttacgaattcctttgttcgaacttgtttatcatgattgtgttataagttattggtattggggagatcataattcgaaagtaattcctcaatgggataaaagagatttgtttaatcgattatatggaactccgccaatgtttttgtttaatcaaacaatttgggaaagatataaaaaatagattcgttcaatcttataaaactgcagaagaaatttcttatttaactggatattatgaaatgactgatcataaatatttgtctgatgattggaaagtacaacaaacagtgttcggtaataatagggttattgtcaccgtaaatttcggtgataaaaaattcggaggtattgaaccaatgagtagtactgtcgtcgtttatacagatgcacctccttgggcaattgctgtaattgtaattgctgctgtggtaattgatggaataacttttcttaaaaaaagactccaatgaagattaaaaataatgtgacttaaataaatattaatataaatgatggaaatttctgtatttaacagatcacattaatataaaacatactttccactggttttctggtgtctttattcctgtattttataatcttctatgtgttacatattttccttgatttacctcgtacgatttcaaacattggttggggctatagtcttctttttttattttattaccacatgtgtttccattggaacacttacaagtatttgtgttattgccactaatggagaaatgaaagaaggcggatgttattatttattatcacgtacacttggtcccgaaattggggctgccattggtattactattgttatagcgcattctacctctgtatctcttcgattacattatgtttctcttcttatcacaaattttttatacatcaaaaccacttttgtcgtcactttattgggatcgcgttttatggcaatttcttttaattagcccctttttcatttagtaatttaactatttctgtatgaccatttgaagatgcacaaataagtgctgtatcaaataatttatataatttccaaatattattttgaaatatcaaattattaaaaataaatattaaataaaacaaataaatagatttagcattaatatcaattccttcttgttcaagaagtaatttaactatttctgtatgaccatttgaagatgcacaaataagtgctgttctaaataatttatataatttccaaatattattttgaaatattaaattattaaaataaatattaaataaaacaaataaatatcctgagcattaatatcaattcctttttgttcaagaagtaacttaactatttctgtacgaccattataagatgcataaataagtgctgttctaaataatttaaataatttccaaatattatttgtaaatataaaattattaaaataaatattaaataaaacaaataaatatttttagcattaatatcaattcctttttgttcaagaagtaatttaactatttctgtatgactattccaagatgcaaaaataagtgctgaactatttaatttaaataatttccaaatattattttaaaatcgaaaattattaaaataaatttcaaataaaataaaaaaatatttttagcattaatatcatttccttcttgttcaagaagtaatttaactatttcggcgtaaccaaattcagatgcacaaataagtgctgtataaattaatttacataatttccagatattattttaaattatcaaattattgaaattaatatcaaacaaaataaataaatatctttaacattaatatcaattccttcttgatttaaaagatattctacgagttcaatgttccctaattcgggagagtatgcaaaaatattttttggaattggattttctttcagaaaatacttaatgagataaagatttccaatttttaccatattattgagaatattttcatttattttcattccatttttctgtaaaaacataaaaacttcaatgttccaaaacataatacatagagagcctaatttttctatatcatcaatttcgataattttattttcataaagataattaaaaatatcatttcgatgaaatttaattgctgtttcatatgcatttttaaatgatgaatgattttgttcacataaatgaataatttcaatgtttccacctgcaattgcatatttacctgtgttttctacatttgcaccattcataagtaaatgtttaaaacatttaattgaagaaaaaaatgctgcataatcaattaatgaaacattttcttcattaataaatgaacatctttcataaactgatggttcaattatttgattaaaatcaaattttggttgtgatgttatttcttgaagtttttctatttcatcatttcgaattatttttgcaatttcatttggattatgtccttctttgattaatttcttatgaagttcccaatcattctttgataattcttcataattagcaatgatttggttaaaagagctaaaatttttttgtttataaatttcttctttagacatataatggataaaatatggatttttctcatctttcaatattttttagatcaagaatattattttcatacattttcaaaagtggataatataatttttgcttgtaaattcctgtgtaatttggatcgaggtcaataaattttgcaaaaagaaggaaattagtaaaaacatcaaaaattttagatttgactttattggtttcttgaaatttttcaatttctttcataaaattcaaatatatatcgaaatcattcttttcaataaaaacacagataataacataatgactcataacaatattaaatgaatatggataactataatcaaatatggaaataattgattgagctgcttgagaaatattttctttatttaaaccaaatatgatttgttgaattgatttaatgattttcatttcttttgttcctggtttttgattgttttcttgtaagttactctttttctccaacatgaaacaaaaaaaaatgtcagttttaactcccctcaaatcaatttgccacacatcatctcatataaatagattttatcaaagggctatgaaatgtaaagggaaataggctgagaaaaaaattattacgtttacaagctatcatttatttatggtaatctttaattaaaaatttcttgagtgtaaaagaatagatctttaataaataataaaacttttattgaggagttacaagatttataacaaaataaataatattacgacaaaaatgtcactcataaaaaaaagtaaatacaataagcgatggtttacatagcaacatattaaaagttaatttatcttcataattttttatatgttacgctgaaagttgtttttctttatcctgaggacaactacaaaacggacacaaaataagaattacatccagtacaaatgaaatgacatataaataaaagaacgcttcgatgcttgagtgatatttattacatgtttctttatcaaatcgcaatgcttgtgtttggatatttctgatgcttgaacacttatttggtgctgaataagcaaaacagcatatatctgatgataaattgaataatagaattaaaaaataatataattaaataaatgtggtatatcctaccagggattttttgacggattttgattggaataatcaagaaaattataataaaaaaggcaagaacaattggtgacacccatgaaatagtagtcataacatataaaatatacaagttgtaactaatgttttcagaatctattgagtaatcatatctaattttactccaatgtattccagacaaaaatagtaaatgcaatgcaacaaatgataattactaaaataagtataaaaataataacaaaatatgaaagaaaaatagcgctttcagtaggtgaaaatgtaatactcatttcgaaaaaaaactttgaaaatatctgaagaaatcacttttcatgtcaaacaaactttatcaaaaaaaattgatagtaggcttatgttaagcaatgaacacaaattccaaggatttgtaaaacatgagtcctattatgctttgttgcaaaaaattcttatcaaaagtatttttttttatcataatatccaatatgaatatcaagaataaatgttttaaaacaaaataatttttaaatctcattttgaaatactgtcaatattttaaattcactaagcaattttatatcaaggaaaatgttagtgaatatttattttgtcatgaactccaagtgtgttattttcatccatattcaaagtaattttttacagatgctaagaaagaagaaaaaattgatcttttattaaaacttacttacatatgcaagtgtatatttcgtcactaaaacatattcaacaaaaaatcagaaattttatttaccaaatcgtgcattcaggggtcatattaagttttttcctgatagaaattcatcttttcttcggaaggtgccactccaaaatcgccgtctgaatacactcttattaattctatcaaagcgaatcgatcattctgcttttgcgccattttccaaaaatttccaaaattcgttcattatttggtgggttttcttcttttaacaattttatagcgacatctaaaaattggaaattttggttatcgaacataaattgacataactccaaagctcttttttggatttttggcaacatttcctttcccatttgcgtaaattttaattaaagtatcaataactttatagtaattcattttaattaattcttcacatatatcgacagcttttttgtacattttgttctattccattaccatttaaatatattaatgccatgttatgcattgccattgtgtccccctttctttcttgccatttcgaaatattctaaagctttcggaatattttttcatttcttcatcttgtgaataaagtacacctaaattataaattgcatttaaatgtcttttttagcagcagcttcataatactcggatgctttatttaaatccttttcgactccttttccataatgatacataacacctaaattagttaatgcttgaacatggttattacttgctgctttttgatataattctaaagatttctttttatttttaggtattccttcacctttttgatacattaaagctaagttataagtacaatcatcatcacctaattcagaacctttttcataataatataatgatttataaggatctttttccctataaatttcagctaattttttcatcgaatttaaatcacctaattcagaagctttcgttaaaagttcgattgatcttttcggattacgtggcacaaaatgtcctggtgtattaactagtaaatttgctaagttatacattgaacgtgtatgattttttaagattgcttcttcataacattcaacagacctttgaataagactcgtgttcttcccaatatattcataatattctcctaatgaacataatgcatcaggattcttagttttggctgattcaactaaaattcttccacatttccctaaatctggtggaatctctttgtaaccatcgcgataaagcatcgcaagtcttattgtgcaattaaaataccctttttctgatcctgtttctaataattcaattgctttttgacaatcatagggaacattttctccacttaaatattgtaatgcaagattatatatagaatgaacaaaacccttttgtgctgatgtttcgagtaactcaataccacgtggaatattttttggaaccccattacctacaatataaatcatcgctaaattaaacatagctgtaagatcgtcatttaagacacatttctcatataagttgacggcttttgggatatcaattggattacctcccaaaccgatatgataaatttgtgcaagattaaatgatgcatcatttattcctgcatcagaccctttttggaaatattcaatcgctttattgatatcatgttcaataccttctcctcttaagaataaattaccaagctcaatatatatttgtggattttcttttgcttgttcttcaatttgggataagttctctttaattttagaaaaatcagtcataaaattttgtttggcaaatctttttttattaaatagtttatatataggatttcagaatgttgtgtgatgtgatgtgatgcttgaactgcttcaaaatctactcaaaccgttaaaaacaatgaaaaagccgatacataccgttagtaaagacggaccataaataaaataaagaagcaaaaactattaaatgatatcgaaattcatcaatcaatcatgcaaaccctctttaggttggctaaaacaaatattatagaatcagcaaattcaataattgacatttttgatgaaaatcatcctatttcattcaattttatattagcccaaacaatatacacaatttccatgtttagaatgaatgactttgatatttattcaaaatttttaaaacaaattgaaatatttgaagaaaacaacaaaattaattcaaaaatttttgatgtatttgaaggtgtacttctttctaaatattcagaagaatcaaagtatattctttattatctttttgaaaataaatttcttcagagtccaaaggttgattataaaagaaccaatgaatgtcttgcacatcacatgacgcaagaagaaattaatgaatattattgctatggaattaaacagtatataaaaaaacattatgaagaactttcaaagaatgattgggaacttcataagaaatatattgaagaaggacataatccaaatgaaataacaaaaataattcgaaacgatgaaattgaaaaacttcaagaaatatcatcacaaaatgattttgattttaatcaaataattgaaccatcagtttatgaaagatgtgattttattaatcaatatcggattacattaattgaatatgcagcatttttttcttcaattaaatgttttaaatatttacttatgaatggtgcaaaagtggaaaacacaggtaaatatgcaattgcaggtggaaacattgaaattattcatttatgtgaacaaaatcattcatcatttaaaaatgcatatgaaacagcaattaaatttcattgtaatgatatctttaaatatctttatgaaaacaaattagaagatatcaaaaatttggaatttttaggaaagaaatgtatcaaatggaacaactatgaactctttacatatttgcaaaaagaaggaatggaaattaacgatgatattattaatgcagctgcaagaattggaaatatatatctcacaaaatattttatgaaagagcatcacactccaaaagatattttaggttattcatctaaatcaggaaatattgaacttgtaaaatacattttagatcaagaaggaattgatattaatgctaaagatatttattttaataatttaatatttcaaaataatatttggaaattattgaaattatttgatacagcacttatgttagcatcttttaatggttatacagaaatagttaaattacttcttgaacaagaaggaaatgatattaatgctaaaaatatttttttattttatttgaaattcattttaataattttcgattttaaaataatatttggaaattatttaaattaaatagttcagcacttatttttgcatcttggaatagtcatacagaaatagttaaattacttcttgaacaaaaaggaattgatattaatgctaaagatatttatttgttttatttaaaatttattttaataatttgatatttcaaaataatatttgataattattgaaattatttgaaacagcacttatgaaagcatatttaaatggtcaattagaaattaaattacttcttgaacaagaaggaattgatattaatgttaaagatatttatttgttttatttaaaatttattttaataatttgatatttcaaaataatatttggaaattatttaaattattttggacagcacttattttagcatcttggaaaggttatacagaaatagttaaattacttcttgaacaagaaggaattgatattaatgctaaatctatttatttgttttatttaaaatttattttaataatttgatatttcaaaataatatttggaaattatataaattattttttacagcacttatgattgcatctagaaatggtcatacagaaatagttaaattacttcttgaacaagaaggaattgatattaatgccagggatatttatttgttttatttaaaatttattttaataattttatatttcaaaataatatttggaaattatttaaattatttgatacagcacttatttgtgcatcttcaaatggtcatacagaaatagttaaattactaaatgaaaaaggggctaattaaaagaaattgccataaagcgcgatcccaataaagtgatgacaaagtgggcaatctaattagatttgttccaatcacacgaggataatttagatttgaagaaaaagaaaataatcattaaataaaaaattttgaaaaatatgttttataggaaatttgtatcatcaatcaataatgaaaatgaagtctttttattacactttttgataatcaattaaattatttacaaatgaatttcattaaattcgtcagtccatcctaaagcatcaattatttgtttgcatatttcttcgcaatcgccctgaaggaaaatatctcttcgatttgtaacatgaccgaacttaaacagttctttatgactattctcagctaaatcgaccaaaacatttcgtctttcgtcgacgctgactttttcttcatatgtcgcaacaggttctttattaatcaaaactcgaagacaatctttttcgacaatatccaggaagtaatgagcatggagtaactttcagtgacgtaccaataacaataagaaggtccgcagatgcaaagtcatttggataaagatgataaaatcgctttggaagtgattcaccaaataatacggaatcaggtttaacaacccctatcccacattttttgcaataaacaactttgcctgtcttgagctcttcgaggtaatcttcgtgtttagatttatcgccacaatttcgacatgtattggtggaataagttccatgacattcaactaattagtttgtaaaaaagttgaaaattatgattaatttaaagaagtctggaattataactacacagaagaatcaatatctcctagaaaaagcacaaaaatggagatggataaacaaacaattttttttttttttttgcaaaatttcagaaaaaatttgatggtgaattattaatcaattgataatataaatccaaaatttgaaattaaacatttaaaattaatacaaaagcaaattatacaaaatgaaataaatttgatttctttgtttagtaaaataaaaaatgatttatttaattcttttaatgttattaaggaaataattgttaaaacatttgaagaaataaaaaatgaaaacgaaataaaaataaatttttgtgattttgttcaaagtatttcacaaaataaaaatttttgattgtaaaaatgaagtaaatttaatggatttagaaaatgaaaatgttttcgatgaatatatcgaagtcatatttaaaaaattggaaatgttttgtaacatttcattaaacgaaacccgaaacgaaataattcaacagttttcaaatcttttacaaaaatttatacaaaaagaatttgaattaagatacgaacaatgtttggataaaatgaagcaaacttataaaaaccaaatacaaaatgacatcaattaattaattttttaattttcaattaaacaaattatgtgatagaaaatagcattttaaattctaaaatgatataaattatatacagtataatatatttaagccaattattgatgaaaatattcaatatatttcgagaagtttttatttttttctttcaatttaagcatttgaataaaaaaccgtcataaccacttaattaacagaactttatgttgacaattttgtatcatctatctaacaatccacaaccattgtttgccatgactttcaactccaaataacaaaatccaagttgatgattcgtaaaaaaagttcattttattaagaaaaaataaaaattggtacctgtggggttcgaacccacgcacctctcggtattggggcttaaatccaacgccttagaccactcggccaaagtaccaacaattttgtataaaaataataatatctaatgtgatttgattcaatggtgaatcaacattttcaaatcacatgtcaaaggcaataaacaataccacttttcaaaatgctcatccaagttcacactgtatctggaagaaagcaccaaattgatgttgaaccaggaatgacaattgctgcaataaaagaggagcttcaacaacgcgaaggtatttccgttcaacaacaaagacttttattccgtggtcaaaatttgaacgatcaagcaactattgaatcatcacatatcaatgcaggcgaagttctccatatggttcttgcccttcgtgcaggtttttaaacaataaattttaatttgatcaattttcatttctttttaaacctaacgttaaatggcctttttggtagctctccttttttttcgtgttgcttacatgtgaatttgatttcataaggaaatttaaaaaactcaaaactttggaaaatcaaatcatctaaaatgacacaagattgcagggccatttgttctctttcatatcattctttataagaaagattattattcaataatactgtattatgtgtcagtattgcaaaaaaaacaaagagaaaaagatcgattaaaataggggtatcccaaatttggttggatgtctctcccaattgctcctagccaaactctctatctcaacaacttgaatgacaaaatttcaattccagagcttaagagggaaatatattgccttttctcttcagttgcccccgttgttgaaattgaggctcgaaaaggatcaaaaacaagaggccaagcatgggtttctttttctagtgttgaaattgctaatgttgtcatgcagcgacttcaaggatttaatttgcttggaaaagatcttcatattgaatacgccaaaaataattctaaagtaattgcagaattttaccagccaagaggtgagacagaggaacaacaaccagagcctgaaccagaaacaaaggaaacaaatagaattcttaaggtcacaggatatccaccaaaggctgattctcgtcttttatccgtcattttcagacaaactcctgggttccaaaagaccgagatgatggatggctttgctcatgtgtattataatgatgaaacacaagcagccgatgcactgaacaaatttaactcattcaaaattgttgatggatataatcttaaaatcgaattcttataaaatatttttcacacaattttcattgaaaatgcatttaatgaagagataaaattatgaatcatttttacataggaattttttaaatttgaatttgacttgattttttccacaaattcgatagcactatcagaaaaaataaattgcaatttgttggaatgaaataacacttttaattcaaaacaaacctaaaggaaatattgtgtgtgaaatgatcggtcagcgttaaaatattctgaggattttacctcagaaatcggtaatgaaaagtgttatacaacaattcaaatttcccctcgttgtcagtttgtttttaacaaattttaagtttctgccggtttgaaattgatgtttttttctgatggatttttccaaaaaatgacgctgacgaaacgttgatgaaaaatttgagttggggttggtcataattagaaactttgaaaaacctcaaaggatatctccattgagaaataaaatctggaccaattacttaattcaaacctttatctaatttttgataagaatttattttttgaatagaaaacaacatgttgttaaaaatcattctgatttaatggcgaaccaagaatgcttatcgaagcaaggctttgcatacaagcccggcggcatcttcaagacatggcaaaagcgatggtttgtacttgatggaaatgttttaaactacagtaaaaaaccagggcagaaaagcttcaagacaatcaatatgaaagaagctgaagaaattacgcttgatttaaagaacaaacgaaaaaatgttgtctttattcgtactgataaaaagaaactttatcttcaattcaagtccgagaaagaaactcaagaatggatgaaagaattagcgcaagctaaacaaggtagaaagaaagtcaccatccaaatcactgactttactgttctaaaagtcattgggcgtggttcatatggtaaagttcaattagttaaacataaaagtgatggtcaattatatgcattaaaatcattatccaaaaggttcttagccgattataatctcatcgggaagaccttaacagaaagaaacgcattactcaaagctaatcatccatttctgacatcagctcgttattcatttcaatcaccaacaaaattattcttagcattagagtatgttcctggcggagaattatttactcgtctatgtaaagaaaggaagttttcagaagatcgtgtaaagttatatgttgcacagttagttctcgcgctttgttatcttcactctattggaattgtacatcgcgatcttaaacttgaaaacatattagtcgacgaagatggatatattaaactgaccgatttcggtctcgctaaagaaaaaatggataatgaaggtgacagagcatcaacgttttgcggtacgccagattatgttgctcccgaaatgctcttgtcgaaaccatatgataaagctgtagattggtggtcgctcggcattttaacatatgaaatgctttatggtcgttcgccattttataattctgatacaaatgttatgtttcgctcaatagtttatgaccctgtcgagtttcctgttggaggatcaaatgaagtaattgatttcatatcaaaattgttggaaaaagatcctgcaaaaagacttggatctggtccaaatgaaatcgatgatgtgcaaaatcatccattctttgaaggcgttgattgggaaggcttattgttaaagacagtgcctatggagtggaagcctaatttatgtagtgatactgatacttcccaatttgataagcagttcacaaatgaaaatcctgtgttttcgtatgaaaaccctgaactaataagtgctgaaacgcaagaaatgcttcagggattcaccatggaaaatgcttgtttcatagatacacttgtttaacaaacttatgatttataaatcacttgttataataactttttcttttcatcaaaatctttgatattcaaaaagttatatcgttttttgcaggcgcgtttggtctttctcaagcattcaacttattctcatcttttatcaatagaaatactttagtttgcaattaacatatgtcgttcattcagtttatttaaagaaatttatttattattttttttttcttggaattaatgatatcattaatcaaattttgtatttttgttttatttaatggaattcacagttggtaagggtggcgactgtaatgttaccttgtgggacacgaagcggtactcctttgtaacatgcttgtccatcagcattgattgtcaattgattgtttgcgctcacagctttccaccactttcctttgctatcaactgatggcttaatttcaggatttacgaagtctccgcagagaacgcgagttccaaccggtgtatcggcgggaggtgtcaaaagttccactttcgaatggtcagcgttcgagccggcgaaaaccatagcctctgacggctggcctcttatctttccaggtttgatgttagtgaagacaacaacaaggcgattttccatttcctcaattggaatgtaattacgaacacctgtaataaccctcttgataacaccatcaccaatatcaatttcttcgcagtagagagtatcggcatcgggatgtggccaaatttttacaattcgtgaaacacgaacatcaatcatttggaatggatcacattctggttctttaggagctgctggctgcttgggcttagcttgcttcttggctttcctgccgccttgtggtaattgttggtcattgttattatttttgtgagattgattgttgcctttttgttgagaggcttttgtacccttgttcttggaatggtattctcccttttgaacttcaattggttggaatggatttccaagttgggaattaataaagagcatccaacgaacaacatcggcaaaatctgatttcttttcctgatcagaaagatctttggcagatgggtaaagagccaaaaacatgagaatatcagccattgttaatgtatcagaaaccaaataagtcattgtcttaatgtgtgactggatttgaccaataacagcctttacatctgatttacttgtttcgttaaatattgaatcggcaattgatgtgaattgttcaatcaaagctgaattttgagcatcgccatctgcaagtaaacgcttgctcacaagcttccctccaaccttcgtagtacgagccatttcatttgcaattgaaacaaatccgcaaatttctttttctccaaccttaagtgttggaattgtaatttctgtatcttcattaaaatctgcattaaaaccaatgtactttgccacaatttcaagggaagttttatattggtatccagctggaaccttaatagacattcaagtggtcggatccattgaactgcaggccaattttgaattcaatttttgtgagcacaaacaaatcatttttaaatggaaaatgactttgccagtaaattttgatcaaaactacaatttgacaaataaaaaatttttgcttgagaacaattctttttttaaatatttttacttttacactttgtttcctagtgtaataaaattttgcaaaattgcaataatattaatatttcactgttcaatgaaaatagaaaatttaattactttcacttttaacactattctggattttattgtttttttaattaatttcaaaaaaatttttttaaaattagcccatttgttgtttggaaggtttgaagttttagttctgaattttgtcaaaatgatgtatttaaaaagtggtattttgaaagaaggagttcttctacctccatcacttcatttcatgatagttccaataaattctcttccacaatacaaggtttcgcttcttctttcttcaacttcttatccgccattgtatgtttcagttgaaggatttcgttttaatgaatcaatcaatacatatgaatacttaattgaaataggaatttcaaacgggaacacagtagatgttagatatttcaataagagatattccacgttgtttaaatttgcctcacttgtaaaaaattatgttcttacttttcaacctaacttggaattttcccaatagaaaatatttggaaagaatgaccgaaaatttgtaacagagagatgtcaaggccttcaattatattttgagaatgatcaaaattcctggggtttgcaatttgacaatattcaaaaatactttctaaatttatcctaatataaaatgcttcacgtgattgttttcattaacacagaatagttcacatatcacttatgttgaattttttggttttcattaaaatttatttaagcttcgatttttttgaatgattgaatgaaaagtgttaatttttttatgagtcaaaataaaaatttggaaattaaacaacttcaaaaaatctatcaatatatttacgaagcaaaactagaaaatttaaattcagtagttcaaacaataatcaaatattttgataaaaattttccttattccttcaattctttgctttgtaaatttgtatattcttcttttatttcacatggaaagggaattaataaatatattcaattccttaaattattagaaaccattgaagaacaaattttcacacaaaatccacaaatttttcaaattttatatgaaataattgttaattattgtacaaatgattctcactacattattgctcatttacttgaagagaatttaatttctgctgaacttgttaaaaaacataaacattatgatgatacaaataatccatattttatgcatttaattagtttaaatgatgatatagaaaattatgttcatttaagaaacatcaaatttccttttcccattgaagaactttcaaataatgattttgcacttcataagaaacttgttcatgaaggacataatccgaatgaaatcttaaaaataattcgaaatgatgaagtagaaaaacttcaagaaataacatcacaaaatgattttgattttaatcaatacattgaaccatcaatttatgagcgatatgattttattaatggttataatgttacattaattgattatgcagcattttttggttcggttaaatgttttaaatatttacttatgaatggttccaatgtaaatgaaacaagtaaatatgctgttgtaggtggaaatacagagataattcttttatgtaaacaaaatcattcatcatttgaaggtgcatatgaagcagcaattaaatttcatcgaaatgatatctttaaatatttatatgagaataaaattgttgaaaatattaacttagaatatctcggaattaaatgtattttatatcataattatgatatttttttatatttacaagatgaaggattagaaattaatgatgaaataatcagtgaagcaacaactgatggaaatttattttttattatgtgcttccttcataatattaaagatataaataaaatatttttcaaatctgtaagatcaaataactttgagcttgttcaatttcttcttaaacaagggggaattgatattaatagaagagatattgatttacattattgaacacttgttttaataattttttgtatattttttacttttggaattttacgaaattatttggaacagcatttatgaatgcagttgatagtcgtaatattgatattgttaaattacttcttgaacaaaaagatattgatatcaatgctaaagatatttttttgtatcgtaaaatgtttttttgaaagaatatcatgtttaataattaaatttggcatttatttaacttattttgggcagcacttattatatctgtacaaaataatgattatgaaatggttaaattacttcttgatcaaaatggtattgatattaattcacaagatatatattactttataatgatgcttattatagcaaattgatgattcattccaaaagttggaacttgttttaagtttttataactccacttttagttgcatgtgaacaaggtcataatacaattttgaaattacttcttgaacaaaaaggaattattataagtcaaaatatttttttaaattatttaaatttttttctaataataacatattccaatataatatttggtgtttttgtgcatgacttttttctccgcttatgggtgctgcatgctattctaatactgaaactgttaaaatacttcttggacatggagaaattgatattaatgctaaagatatttaattgttttatttgcagttcatataaaaaatttgatgttcaaaaatatgatttggaaattatttaatttatttcaaacagcattaacattagcaattattagtggtaaaatagatacagttaaattacttcttgatcaagaaggaatcgacatcactgttgaggatatttctttatatattttaatgtttgttttagtaatttgaaattaaacaattttatttggaaattattcaaattatttaatacattacttatgttggcatctaaatatggttttagtgatgtagttgaattacttgaagaaaaatctaatgctaagtcaatttaataatcatctaaagctaagatttgtaaggaaaaagttgtgtaaatttttataatttataattcttttattcactactagtatttataatatctatatttaaacattaaatgatattttacttaatttttcacaaacgatttagtattcaaaataccttttttttgcagtttcaatatatattggaacattttttttttattattaatttctttattcattatacaaatttataaagaacttcataatatgaatctaactatgtaatttcttttcgaatgtaaaattttattaatttgtatattatgaaaccaaaaaaatatattttaaagaatctgataaatgaatatttcataaaaaaagtgaatttaatttcatttatgtataaatttttaataagatttttatggtttgattgattccctcattattgatgctgcccacattccgccagttccatcatttgatctaaatgtttgcgtttggccttttccccaagtgattgtccattctttcccatcttgtgcaacattcactttgactccattcgttaatgctattgccatcttaaactcgtgcgttttgttgttaaataacaaaagtctcttttgattagtcaaaaatatcgaacgctctttccaaccaaataatcgctttctgtcgacaatactattcattagaatggtctccccttcatttagcatggaatctgcaatggttggttgttgttcttcttcgaatttggtgaaaacaggcattttgatatttgacaaattattccaatcaatgcctttgaaaaaggcatggttacgaatggagggatagccttctttggcttccccgtatccaatacgctcgtgtggatcaagcttaagtaaggatgtgatgagatctttggcggttttcggaagtgttttaatgactggattaaacttaagctcagtgatgttgttcattaattcaactgtgttttgtccactaaaaggtgctgtgcctgtaagaagattgaatatgacacaaccaaatgaccacatatcagaactataacagatttttccatcattaaggagctctggggcaacaaaggctggagttccaacaatggatgaacgatttaattcttgactatcagatttttcaattagggctgtaccaaaatctgagagaagaacgtggttttgcgagtcgaggagaatgttttctggcttgaggtcacgatggataacatttgctttatgacatacacagattgcttcaaaaatttgagcagaaagaagtttaactacattagtgttaagacttccaatatcccctacggcttctgcaaggtcaccatgttctgctaattcaagtacaaaatacaaatttgaatcatccttgaacgttccatataaacgaacaacaaaagtactagcacacttaattagtgcatttttttctacaattggtaggctttgttttttcatcttcataagacatcttctattcattgcttttaatgcataaacttttccagttccaacttcaacagctttataaatttgaccgtatgcgccttggcctattggggattcaacaataaaatcttcaaggcgaaatgctgtctgtttcgacattttgcctaatttatatccaaacgaactcttgtcaaatttttgtgtggatacacaaaagtgtacaatttattctgttctgacatattcaaatttgaaaagtttatgcattcaaaaagtatttttcaaaaatttttgtgaaaaatcagaccaccccaattcatcagttcctttttattttcatatcgaaaataagattaacaaagtttttatattaaaaaaccaaagaaaagaaactattttataaaaaaaaatatttacccaattgaatattcttctattttttgctattattcatcttaaaaaatggcaaacaaagaatgcaactactacttcaagttctccatcaacgaaaattatcttcaaaatcttaatttatatatttctagcaattgcaattattataatatttctcatactctattgtattatcacacaaaacaaacatatccataaataaataaataaataaaatattttaaacgaaataattatttatttaaaaaagatcgaaacatgttgaataagaattcaaaatcggacttacatacgcaggatatcccactggcaaatcacaagattgaatcaccaaattattcaatgcgccttgattcgattgtattgaagttctttccgactccgaattcatatgatacattaagtcatgttcttcatatgcccataaacttcttacatgttcggaattaattttgtacacagaccattcgagtttatcagatacattaaagcgcaacaaaattggttcattattctgttgttttgccactgttaaaattgttctttctttttccaaaaatgccttttggaattcttccgaatttataggcacgacaacataactttgtaagaattcattcaagaacgcaacaatttcatcatgtggatctgtcgaactataacctaagccatttgagttcatataatttacgccaactcctaaatatattgcacgtagtataacattatttaatattttgtccgaattaaagacccaagagaattgttcatgtaagacaacatctcctttaaatacatttgtaagactgattttgtttaatgatccgtcttgattatagacaagtttaccaatgatatagaacaagattaaatatttgtgtaatgaattgtcatcaaattcgaattgtgattgctccaaaaattggcgcattttattatcatatgcaaaatatgctcgagtttcatggtctaaactttgagggatttcttgtatttcatttatatcaatatgtactttagttaatatataacataaacaatttaaaaatcccattcgcatttgttcttgatcaatacctgagaaagaagtacttaaatcagtttttgtcgtttcatacatagatatattaaaacttaaaagtcttaaatcaaattggaaaacagaatctacaaaagctgcatggaaattaggtaatacttcataatcatcaatgattcgttttaagaagttaatctctgattcatgacatgcagtttgtgctgaatattctaaacctctcatttggattttaatacaatttggttcgatagagataacatgtacaatagaaataaaattattcgatatgaatataaacatgtcaccaacattaacataacctaatcgaccattccgtacatatttagcaaatgattctgttaatccatgtgacattgagaaatatactggcgtttcaattggatgatcaatgattttcgtggtaaataattcattaatgttcggttcagtagtttttggatgatcataaaaataatatggccgtattggatgtggtgttaagaaatatccaattcctaaatatttacctgtgttaccccctgttataaatgcccaaattaatgttggaactttccaacaaaaatcaattaatgggaatatatcaatgagtttaccaataacaagaaatagtgctgttaatatattttgtgtgtaatcaacaattacttctgaaaataacataactatataacgactcttatatacattttcgacactatgataaaatgattcaagtttcgttgcaatgattaatgataaaaagaaattcgttgaatgatcagtcaaatcaaaatcataataaaacgtgacaatagataagaaaatagctattactatgatatgtggttctgtatatgatttataaactgcatgtactattaaaaatgaaatataaatcggatcgagtttcgtattaactaatgtacatgagataaatatcgggacaataaattgtgtaattaatccacgaataaatccaaagattttaatatagcggaaaaagatacaatgaaagataaaatatcgttgacatgagtctaaaaatggaaatactatgtcgctagcagctaaaataccaaaacaaacccatttaacaacagaatattttggttttgcaaaatgtgtaataatatatgatatcaataatgatattgctgctgatataaatggtccgaagactactttttgccagattttcttaagccccttatcaggaattggtattaaacttaaaaatgttgctatcgctatagatgctgcaatatgtaaatcatcaagactatcttgtaacactccccatacacatgctacacttatacatccacgtactaattgaataatcatatgtattatacttccaacaccattttgaccaaacgcataacgacagacactttcaatgaacgatacaataaccgaaatggggtgccccaccattggcgctaaaacccaaaattgaaatagaatcattgcccatttaaagacaattgaaacgattggagtaatagtattccaattaattgtcatgtcataaaatggtaaagtgctgataccgtagttttcttgaagttttaagaatgcaatccaaagtccacagattatggatatggctaatgcacgagctcctccaccccaacaatcattaatattcataagaaaaggatcatgtgacggaggataaaatatcgtataaacactagaactaactacaaaggccacccaccatttttcacgatctagaaattgatctcggacatataaagaaagatatacacatgcaaatgtgacgatgagtgtgaaaacagtatagccaactgtgttattcaaaggaataaaattttcaatgaatgacctttcaaataaatttccaattggatgaagtttgccgcaaaaataaaccatatcttcggttacagtctctatcacaacaggagaaacttgattgtcttttaagtaatcaacaagattaaaaatttcatcacaatcataaccattttgaattaaatcattaacaactacatcaagatttggtgatgggttttttagtaagtctctgacactccatacttcttctgaaaatccttcgggaatatcgctctgatttggttcgtttgtattagtaattgttgttacagaagataataaagaattgataacatgacctgcgatttttgataaaaagaaaattactgcaagaactacggctaaactaataattgcaacttccgtaatcctatttaaataaaaatataattcaaatataagtaacaaggctaagtaaagagcaatcctgacaaaatttgcgaggccaacagaagtaaatttaattccaaaaaaagatatgggaaagtttacccaatgaaccatctggggaaatttgtaaatctatcaaaaactgggagttcgaacaaaacattttttcagtgtattgaaacaaattttcattgttttacaaaaaattaacagaattttcctcaaacaaaagaaaagctttgaaaatttttatcatgatacgaaaatatttagccaagagacaggtttgagttttcaagatgaaaacaaattcatatttttagtgaaggattcaatagcttcctctatggctttttgtttaatgggcgcacagttttcttgccattttccatgtgatcaaataaaattcctttggcataaatttatggctttctttttgttctaaaatatattttatgagctgctaattttttaaaattgcagaaaaaaatgaaaaatatttcctaacagtttatttcataatatgataatgttaattccttaattttcattttcctaatgaaaaaataaaatattcataattttgatgtttaatacatttttcacataaaacaaatctagattttactgtttataataaattttctttgcttaaatcaaaagaacattgactataaattcaaaaggtatttgtgttttttatccttctttacgagtgaaacgtttttgcacgcagtaggatacttgttgtgcaaaatgaaaaccgaaaaatcaccacaaaaagttacaaaagaacgtttgtgaacaacatagccgtttagtgtggttcaagaaaacaacaaaacattgtagtactagctttattatagctgtgcatccctatgatcatcatcctcattttctgaatcatcggagttgcttgaatcacttgaagatgagctatcactagaagaactatcgctagatgagctatcactggaatcatcagaatcttgggtttctttgaactgtgagtcttcaacaaatatgctctcatttgtttccaaaccataatccgaaattattttatcgatgtcagttttcttcttaaagtcttcaacgattgtttgaatctcatcttttgacaaaagatcaatagatttctggagaacaccgtggttgaggagctgtgtgttatattcaataggaagtgtttcatatacttctgctttttcagcgactgctgcagctgtgatttcttggttaggttgaccccagttgtattgtatagatgtaattggttcggatataactgttcgtggatatttgatattagttgtcttataataataataactattattccaaccggaattagaatcatcattttcattatcaacatcatctgttatcaaaggttttgtttgacgtaaaggtggataaaaacccataacatacatatcttcgttaaaaggagttgaaatttcatgaattaagttagaaagttcccacttttcgagtttataaattactggtggaaagaactttctctttatcaactctttttgaagaacttcaatcggaagagacattaaatcattggcaccttctaccaccccattatctataggttcattttcttcaccactaccttctacttcatattcatccttccctggtttctttggtttcctgccaccgcttctggttctcataacttgtgaagtatgatttgctattcatgtcacttttgcatatttggtgggtgagtaaaacattgaaattatcgggcaccccaattccagtgttggtttgttatgtatgacacatgttttttaaattaaatttctccatttgtttttgtaaatttaaactagtttaaaaaaatgaaatattttgtgtaccttaaaggttgtagccttaggtaggtggacgttataacgataaatttatttttgaatgagatctctatcaaaataatttttttattaaattaaataaaacaaggataaacaccaaaagcaaccaagcagtgtaggtaagtgtatcaaaacatttttatttttgttgatttaaatctgatattttctttctattgtcgtgattaataataagttctttttcatagcaagcaataagatgtggcattgactttccaatgatttgttgggttttagcttccattaattcgatagattttaagagagattctccttgatcagaaaagaaggatgaatatgcgttaaccctcgcttttgtttcttctacctcttcatggcttaatggttgcccattattaagtttttctaatcttttttgaagagcatcaattctattatttgcttgaatcataaattcaatttgtgtagggtcaaaacatacatcagtttgagttgctctataaaactttgagatatcttctttcatttctctttggattttatttctttcatcgatttcttccaaaatcattctgtttaaatattcttcagtttcagtgcctaacattggtatgtcgtttgtaggaaagatttcaggaagtggtgcaaaatttttttcttcttgcatttgaaaacggttttttgctttgtgacaaataacgttctcctatttaacggtctcatgaacccatttttgaatactttaatcacaaagtgacttaatcaaatgctattactttataataaaaagtgacattgtttgaagaacggttttcctgggtttttatttcatatatacaagaacttccgtattactttgtttggatataaaacttgactttgctgaagtatttgtgtaacagagatatagctaggaaaaataattataaatttattaatgcttgaaattttgattataccttttttatatagcagaaaattgaataaacaaatactttgggaatgagaagttagcaaagctcataaattattatcttaattaagtttcttccattggaagaaaactgtccaacgaaaatcaccggtagtaccactttttatgtactttacaaaacaaaatcgacatgagcgaatacctcgataattattcaccattcgaagataacgaagaacctttaaaacctgtgacaaaccctgttcctccaagtccaatagctactccaaaaatatcaagcacaataaactcaaatgaagttacagaagaacaacttgcacaatatgaggaacagttaaatcttttagaacactcccttaacaaacaagaacttgaaattactcaagcacgtcaaaccggaagtaatgatcctgctccaaattggccatattgctatccaattgttcactttgatatcgaagaagttgaacctgctaatcgtggcatggttcattctgcatttttttcatggattgttatggcaatatcatttgcattaaattggattggaacactaactttacttagtgtcaaggaaggcgtcgattctccaggttcaaaaattgcactttcatctctttatttattcattgttgttccattagcaattgatttggatgcactttctatttacaaagcacttagtacaaatgcaggaacgttttctttcattaagatatttttatctgtcggtataacatgcctctttgagacaattttagctattggattagatagcagtggaagtgttggcctaatcacaacaattaacctgttcaccaacaaaaatattggaactggcgtttttggtgtcgctgttaccatatttcttgctgcttcagcaatattgcatttcagattattgacacaaatttggaactactatagaggaaccgaacaaggaaacaatatggaaacagatgttaagcgctcggttgctaattttgttgtcgaatctctaaaatgatttaaatgaatgctttaatttagataattttatgaaatgcttaaacttgtaagttcatttatgttattaaaattaaaccaatttgagactttgagatctaatttgttttagttcccaaagattaaaaaatacttttgcattaaagtatttaattttaaatgaaaattttaaatagtgaaaatgtgatgtgacttagcattaagcgatgaccgtttatttggtatgccggttatttgaatacaaattgtttcatcaatgaacaacaacgaaatcctttcatatgttgattcactaattaacgaagaagaaagcaaaagcaagaagcttcaagttcaactagatgctttgtctccatctcaaaaaagtgggcaaaatgatgttgtttttcgacaagatattaaattccatattggcgtttcaagatatgaacgtcacatttcatctaactgtaactacgaagagttgttcaaacaggttgctgaaaaagaaggaaaaacggcagtctttggatatgaagataaatcacgcttcaaaatatggatacgaaatgatcgtgatgttatttgttgtttcagggaatactttggtagtaatttaggttcgataaatttccttattcttaaaaatgcagaattaagtggatttacaaaacttaatttaatcgaagaaattcaaaaatctgatgatacttttcaatttaaacttgcgccttatacacgcgactatgcaattttcacatcactaccaaaaggaatttcatacgaatcagcaattgaatattttaacaaacttgcaccaaacttcaaaaagatcagcgttatggaccttgagaatgacacaattcaaattacatctgagcttgaatggggatacttcctcaatgaatgcgaaatgttgtatccaaaaggaaaatatccaattttattgattgagtgaaataaacatttttgaaaaaatatttaagaagtatttataaatatttgagtaatgataaatcaattgaaaaaataatgtaaagttcattgaagtttcagacaaaaaaaattgagtatcctttaaaccatattatattgtttatcaatttatttgtatttatttttaagagagatgcttaaacatatacaaatttttgtgcgacaaatttgttgaacatgcacttagaaatttgcaaaaaaaataaatcaaatacaacactaaaaatcaaacacaaagaaggaaattatgatttctaaaaaaaaataattcaatcaaatttgatcgttgcaaaaccgatatgcatgtcggaatacaaaaatcatatgtaaagtttttaaaatgaaggttctaaactattattgaatacttttcgatcgtttttgagggggaaacatgccgatagatccatataaaaaattaggaatccatggattttaatttctcgccaaaaaactcagttaaagtaatatcaaactcaacaacatattacccattgaacacacgaaatgaagaaggtttgacacttattaattccaatgcttttcttttccaaaattttggcgaaaatgtaaattcatttcatgctggtgataaattggttgttcttaagatgtggaatgggattttattttctattgtttcagaagaaaattattccgaagaagctttaggttttcttctcaagataattaaagacacagctattttccttctgggcgctcatttcgaaaacttcatgtccaaaaacattgtcgctgcttttcgtgagctatatgctcgttacattgaattatttttcgaactttgtgtaaaagattacaaattcctattaatgctccctccgtattataaaaactttccagacataactgataagattccagtccaaccattatttgaaccaattcaaagcgatcaaggaaaattaattattgaatttattgtatttcgtgatcatcaaatagttgcttgttacactaatccctcagcatcaccactcgaaccaggggatgttttccagatatcactttttgaacgtatggaaactcgaacgacaacatttgatgaaaacgcgcccatagaagagcccacagctgactccattgttcacaggggtggcaatgttcactttgaccataacgttgagcgatgttttctttccaagatacaatatggcaaaagtccatatgttcttatttttgtgaccaaagaagagaaaccaacacctgagcttacgcataagatccataccgtatctaaagacttttgtgccaaacttaatcgatatctatcagataagcataagccgaagccatcgatttatatgactggcatagttcattacattctcgtcaaccgtagtaatggtacatatcgtgagccggagaacattgatccaccgaaatcgaacaacgatattgaagccaggcaatattacttatgcgaaaagataaagcgaaatatggtttcgtttggacttaaagcgttccaaagtcgttacattgcagcgcttcggaatgaaatacatttccaatatacatatgaaattgttgtgcgaaacacaaaaggtcaaaacgttgttttggataaaagcgttttaagtaagtacaacagttctggcgaaacagagtcatacacaaagttcataaagtatttacagggaaagctaaatgataacggagtagaagtatacgaattgtacactgcttacttaggtgtgatgccggcaaaggatgtgattaaggcaaacgcaatgctgttggataaaataatagaaggcaaacataaaaataagcagtaaaaatctatttagagattccactattaatttttgcataaattataatgttgtgattttttttatgaaacttaattgtagcattcgtctgatttagatttttatttaagcaagaattttaattattgagaaaaaattgaaagtttaacatgaaaatgcttttcattcaaatgttgcctataaatatgttattaattttattttaagttcaaaatataatttttataattctatgataaataataattaattatggtttaagtatttgatccagcaaaaattcttcatattgttttgattacaataacaataaaaaaagaaatacacaaaaattattttcctaatgcaattttatagtattaataattatgtaatgtaagttcatctattttctttctattgcgtttattcaaacaaaaaattgatagtatgaaatgatttagttttttgatgaaaatttactttttatattttttaattcttacatgttcaataaaaataattgcaacaaatgacaatatgtttttaacttttatcaaataaaaatataaaaattatataacaacaaacattacatttatttagtaatttacccattcgattcgcaatctaagatgattagcaaaaaacaaaacgatcaatgaaattatcagaagtagtattaatagtaataactctatcattgatctcttcttttctaaattctcatttttcgttttctttactttctttatataaacagttttctttttccttttcgttttcttatttttcttaaattccacaatatttattggcgttttgtcttttattattttttcttctctatcaaattcctctttaattaatccaattttttctggatcaaacagttttaaatatggaaaaattatataaaaaatttctcgcgcttgtccccaatacatatatttatttttttcttggtgttttgtttcgaatgctttaattaatgcatttccaaattccttaacaagttcatccgtcaacaacatctttttattcattaccttaaacatgcttaaaacggaattatgtaaaaatgaatttgttgggaaatggaaaaaatcatttgaaagtttagaaacaactgcaggaaaaccattaaaaagttttttattagttcgaagcatccgacacaaaataagaagagaataattcacagattcattaaacttttctgagtttaaaataatggaaacaaatttagattttcgccttgaaatagaaagtcgaacattcttccattcgactttgtgatttttagaatgtgatttggcatggaaattttgtactagagaaagacattgtctatcacatgtgtctgtggcaaaatctataaatttacatatgaaattatcttttgttaaggatgatattacgttggattcaaggccattactaagacaaacttgtaaaatcttttgagaatttgtgctaagtttggaacttccaatgatatttttacaaatagtgtcaaagaaattaatatcgtgaattatcgaaagaaaatttttatcttgttcttctatcagagaaatcaaataatcagctacagtatctaaatcacattttgaaagtagttctatataaaattcggatttattatcaaataataaatttgaatcgtttttatcatttggtaagacgaactggataatgtcgaaaaagatgtcttgcttcggaggagagtagtttttaatatttttaggaaaatttttataaaaatcaataaatttggaattcttgaaaattttttcttttatgttttgctttaaactctgcattatcaaataaaacgaagcatatgcagatcttggtataacttttgtttcaaaaatataagtgtaaatttcatcaaatttattgaccaaaaaattttgcaattttttatcatttaattttaaccttggaacaaacgaagggtttgttaatatcttttctatttgtggatcattttggtttattagatcgtttaaattgttatttttcatcttttttgataaacgtaagcagccactcgaacagttaacttcataaaaaatgtgacatttttcttcgacccgctgttaataaaatttttgagtgcattttaatcgtacaataaaaaaatcaaacgttctccacttattattattcgtgctcgttcactaagctcagttcatatattcactttctaacataatgcttcttattattataaattgaaggaattactgaacgttcgaataatgattatacatcatcaataagtaatgaatggggaaatatatatcaggaataacataatgaaatttcttcatttggacttaccaaaacggaataattgaaaataaaacgtgtaatggattgtataatgttaacattgtgaaagaagacatgaagtcattgatgattggcaaattatttttttttcacataaactctaacttttgttacttattaccatcatcaaacatattccaaattattaaaacatatttcaaattattcaaatgaatattttttgcattaacattaattcctttttgttctcaaacatatttcacaagttcaatatttcctgattctgaagcaaatggcaaaatatttttggaatttgattattttgaagaattaaatatttaaggagataaaaatttccatttcttgctgattcgtttatattatcagcattaacaattcctttatcttccaaaaatgctaaaatttcataattatcttttttaacacattttgaaaaaaccttcaacaaaaaagtgtaacaaaacaatttatcatatcaaaaaaggtttttaacaaaataatcaaaatgtatatctttttttcaccacttcttttttctcttcgtcgtctttctttttctgtttcattcttgttgtcttcacgaagttgtttgccttaacgttctttatcggtaacgtttccgcttttgatgttgctctaatgtttgccaactttctcattgttcttggcgttgacactgccggtctatcttccaatggcaatctcatttgagttctcgcggtcatacaacgggatctcattactgcagttgccggtcttttttgtgttaatgttttcttttccatcatttccaacttttttattgccattatatacggctgaagttcactttctttctttaactctgcttgtaacttcatcttatgtgctaatcttttatgtgcctctaattctctttgatgctttcgttctaaacatgcataagctcttcgcattgaagcttcagctttcgcttgtgcttcgcgcgtttcttttttctcgagttcttcgcctcgttttttcatagctttcgcgcctttgaagtcgcctgtcaatgccatattcttttcgacgctccgaatctgtatcaaaatcggcgatggcttattaaattcgtttaatgatttcggatcattccattcatcagtaaatgtttttatttcattttcttgtttctctttaagttctttctcttggtcgtccattttttgttgtaactctttaagtcgatgatcccattcatcttccatatgtgaatattcttcacgaacttcttgtagacgcgcgcgagtaatttgttgctcgttttgcgcatccgtttgcatagtataactttgtaatgatttacggatgttgataagagcggtgttaagttggtcgcctttgtcatagtcttgtttctcaatggcttcgactttgcgacgtgataaatgctgcaaaagtggacgtcgcatatctcgtggaatttgttcggcctttttgccacgtttggggtgaatgaatttgttaagttctctgtctaattcttcaattgaataacgtggtggtggaggtgcacgacgaatcggtattggaggtacattgtcagatacaactaaaccttcctcagtggtgggattggcttcatcactagatgcttcttcatttccattatcagatgaatgatcagaatcagatttattgttttgcattggtttcggttgttcacctgtggtattagcgtggttaataggcatgacattttctttgcttgaagatgaagaagaggatatatctttgggtttatctgttgttaagtctttggattcattttcattttccttatcagatgaaatagatgaagccttgtctttttgtttgtcacttggtgaattacttttattagttaattcattgttggaagatgacttgctaagttgcgtatttttttcaggttctagttggtcatcatcgctaataatgttagagatattttcactagcaggaataatttgaggaattgaaattttttgttcttcttgattttttgaagattttgaggacttgctacttttagaattacttgatgaatctgatttgttttctttttcatttgtttcaggattgctttgaatcattctttcttctgattacgtaacgtgttttctgttataaaaaatcgaccgtttattagaacatttgttgaaaatacatttttaacggtctcttcaaaaaagtaatggatgcaactacaaaacaacgcaagagcccattaagatatattattccagtaatagttttaattcttgccatcattctctactttatccttaggaaaccaaaatttgttcgtcagactggaacttttccattcatttggaatagagatttaaacatttctgtacataactatctctcacgagatcctgcaaatcatgttcttattgttactggtccatataaaacaggtaaatcacgacttttagacattctttccaagaaaatcatcagcaataaaggacttccaattagtgttcatgttgaaaatactaacactgttgaagaggttgttgattccatcaaaatatcagctataaaaagtctttctttattatcagaagttttatctcccagtgaagtacaaaatcttggatctctttctgttatccctaagcccaatcgaactcttttcactgatttaagtctttcacgtgcttatcatctcattgaagatgctgctgattctcttcttactcaaccagaagactttcttaacctcatttcccgtttcaacccaatagttaaaccatatatctttgtataccatgctgataaacttccaaaacttaaaacaattgatggacgcaaacttggttcacacatttttaatgtaacatatcatcgcctccttaatcgtgcgcaatattccgagtttgttccctttgttgtggagcttacaaactctcttcacagtcttaaatctaaaagacttggcgaaatgtttgagtttgcatttactgctccaatccaaaacactttagaaaaggtccatgtgactaatcgcttatttacgtcacaagaagcagcggagatcatcaaaaagttcggcggacatggcggatcacttgcatatgtatatgaagaaatgcaaacatatgaaagcttcgaagactcaatgaaaatagtcaaggaaaaaatagactatgagatgaataagttgatgataaaacctgatcatccagtttggtaccaattttgtgtgtccaaaggtgaagttccctgggtaaacatatcaaaagttagaaacaacgcaaaaattgtgggaaaaatgatccgaagtggttatttggcggttaacgcgtcaaaagttgtatcggtggcaaatcctgcagtattggaatacatatgcgctcattcaaagaaagtaaggcatattgagacaccaaagccaaagccaattaagaagaagcccgtaaagaatgttgaacaagcgattgtaaatatttctaattatgtcgaagaaaatattacagaaacaaagcctttgataattatcaatgagacaatagaagaagttaacgaaacgattccagctaatgtaactcttgatgtcaacgtaacaaatcaaacaattccaatagttgaaaatcaaacagaagtaatcaatgtaacaactcacaatgatacagttatcgataatcaaacaattactgtacctaatgtcacaattgatgctaatatatcaaatcaaacaatttcaaatgaaacaattcttcctgaatcaaatgttacagaaacaattaaccaaactgttgttaaagaagaagtcgtaaatcaaacgacagaactcaaccaaacaaatactaataaaacattggatacaaatatcacaactgatgcaaacgtcacaagtgtgaatcaaacacaaagcaacgaaacaagcaaactgaagaagcgctcttggttcggacgtggtaagtaaacgtaaacttgtataacatgaataaaccatttcaatcacttttagtatattttcttttgtttctgttccaacagtgtcaaattcgttgtttggaattattgttatagtaaatatgttcaacaaattgaataacaattttatgaacatattaatgcataaatgaatttgtatgttttgctgtgtggtcattgctggtgcaaaatgcattttgataatataaataaaatattttgtattatcgacaaaaagcaaaaaaataacataaattactcggattgtcttgcatatagttaatgtatatcatataaaattacgatttgatttgcaaattgtttgaataattttcaacattttaataacggctatgaatgatactttggttggttaagtgtttgtaattcgtttaaatgtgttcaggaggattaaaatttgttttattgccaatcaaaataatttggtgaggtaatttgatttttttgtcgagaacctacggttataaacagaattattcagtgggtaataggagttttgatacaaattttgtttgaaaattttatgaaatatttgatgataattttcgttaaaatgctctttggccgcatctaccgttacatttaagctgcaataatgccaacaaaataaaaatttttattcaatcaaaatttgatatcagaaaatttgaataggataaattcgtttatgtattgaatttttgcttttccgtaagtgttgttttcgagtgaaatcagctgttcttttcgttatagttactttcctacgaatgatttttaactgttttagctgtttattatatgataaaacaagaaaaaatatataatttaattattgataaatatttgaaaagtatatataattacccatcatcctgattaaagaaggttacattgaagcccatgttatttgtttttttggaaaaaacatataacaattgatatgatgatatatgaattgaaagatctgacagaaagtcatctaatagaacaattaatttgtgtttgtcctaaacctatcaatcatttaattagacctgtgctataattacattgattcatgaatttttgacatctttgttgaataatatattgtttttttgtcaaggattttgttggctttgacttaacattattagcgccttttagtagcccatttcgttttttgagtaattgcatacatcgtgacaacctagtaaaaggaactgctttatgagacgattcctaatctatcgaaattttaaagcgaaatttacggttttgcacaattcaaacacaaattttcagtgtattcaatccaatttggggtaaatttgaactggtttctcattggttatgaagtgggcccaaacattgcaagaactccaagcttttgtaacaagggatagcgcaacaacaaggacaaaatttattgtgaaaattcttgcaattcttaacttcaccaaagaacatcctgaattgatcaataaaacaggaggatcatggatggcagatggtaagcatttcatcaccaactcacgaattttaagtgagctcatgaagttaaaagttaactctattaacacaaattttcgagatcatggatttagtatattcccaaatggaactgcacagatgcgaacacaatttccaggaatcccagacataagccactggaaaatccgtgttcatttaacgttagatttttcttcacaaacaacactcgaatgtgcaaatattttaccgacatcattatgcccattacctgcacaaaaaatttcctttccttttcccataccaaaagaactgattaagtccttcttaaacacaggtattaattgtgcacaaatacaaaattcgttatgcaaaatctatacttcatttaaatcacttaatcaaatccatttaaaccaacagttgttttctaacctggttatctcacttgctaacacatggaaatcggaaatatgtgcaattcccgaaacatcattaaatctttttatttcctatttaataaacaaacaaacgatgaccattacggaagaaatcaaagagcagcttaagcgtaacttggtatatatcttaggaaatcaagaatcagatattttaacatttgatacctttgttgagtttttcatacgctatgggtacaaaaatgatttccttcaaacaattaaagagttatcatatttcgaccaaaatgttaatcaatcgaaagctaatttcgtaagttggttttcacctatttataaacaaattattaacgtcaacgattggatgttaaacccttcaacagaagtagtgaacgctttttcattatattataaaaatgaaaaaggaatcgtttacacatatatttatcataacccttttgatgatgatcaatcgaaacgttacttcgtattgttcgaagatggaattaaatacgcccaatcattagtggaaatgttgaagaatgttttgaatttgaaattcgaatctcaaaaacaaataaacgatgaagaaagcccaacgtacataagatttgctgataaaatcgctttgcgcggacaaaagaaaacggtgaaagttgaagatcatttcttaaatgaaagtgaaatacaaagatttcaatggattgaacacttggaggaaaatccgctaatgttttaataatgttcaataaattatagtagtacaaaccctagaatttgttttctttgaatttgaataaaatttcataatatcaatttgatgatttgttttgggttcattgatcagaaatgcgttttattgttgaaaaacattgggaaatgaatgagaaaaagggtttaattttagttttatgaagaatgaaatagtttaatgagcaaaatcgttaacgtacttattaattgtgtgcagaataaacgttcttttatgggctgacaaagtttgttctattcggaagaatggaaattacttcccaagaatttgatctttcaaaccaatcattttgggcagcagtcacatttgagcgaattcaaaaaagcctaaatccgaatctagttttaattaatctttctacaaatcatgttaattatgaatcagcagaacttttatcaaacttaatgatagagagcaagactttactttacttaaatcttacagaaacccatttagttaggcgctcttctgatataatttttgaagctcttggagattcatcaattcttgaattttatgcagatgataatattttttacgacgaaagttgtcaaaagcttggtgagtcattacagaaaaatccacctcttcaactcttaagcttgtgtggatgcgacatttcatcaaaagggtgcatttcaattgtaaaaggaatttcaaaggattcaaaaataaccgatttacggttagagtcaaattctttatttgattatggggcaacagaagttgcaaatattataccagcatcaaacttaaccttactcagtatcgctgacaatgaaatatggagtgaagggacaaataatatcattaaagctgttcgaggtagtactatcactgcattagatttaagttataacgtggttgacttaaaaaacctcactagcttgttggtagattttgataacatacaagccattagtatcagtggatgtaaagtttctgaaaaagattttccaacttttatttcgtcacttccaaaaacaaaattaagaactcttatcttggaaagccttaatttccaacctattccaatctcttggcccgaagttcctgataccttatggacaacatattttgatatctttttatcatctttatcagaattccaaacgatagaagatcttcgacttggctttatgaatctagatcaactttataaagtcaagtcaactcttgaaagacttcgccaagaacctttaacaattagttttaaagattttggtcgaactaatgattgttggatatatcattttcctgaatccacgtatgaaagtccagataccattatgcaatggcgcgatagcatcacagtgcacaacgcgttcttcatcggccacatcatcaatcacaccaccgcatcaaataaccgtcaaattgaaattttgaatttgagtcagtgtcaaattgacgatgaaattttatccaaaatcatcaacagcatcgacggccataaccttaagagcatcgatttaagtgataataatggcattactgatgaatccgtcgaatatcttcttcaatatatctctcaatcgcaacttgaatcaattaatctttatgaaacaaaaatcacagattcaggctatgaccgcattttctctcttccacttctccctcttaagaacatttctctctcatttgaaacacatcaattaaatgaagatcaacatcatcaattttttagtagcatcgcatcactcttacgaacgcaagaatgtgttctcgaggacttacggatgacgggctatatcactccagttgacgccaaagaaattgtcgaatcgttacacgagaacacaagtttgaggcatttggaaatcgacagtttgcactgcgagaagtacgaaaaccccgatccagtgatagatccgaacatacagagcctctacgacgacttcaccgaagcgcttgcggatgcagtgatgggcgaaggcacttcatgcagactatgctcactcgtgtacccgctgctgactgaggtatatgtgttcagcgaacgaggaatgaaaatattcgctgacattgaggataagctgaaagaaaatatggaaatgtatgggaaggataatgagtgagcgcgttttctctgtttggaatggtatttttattaataaaaatcatttttttatgcagtgaatgaatcatttcggaattgtaattattgtttgggtttgagaacagtacaaaagaaatcaaaaaaacataaacatctgaacgaaatacagcatttttcaggaggttaacgattagtaaaagtgtgtaatacctttttatttatgtgtggacaaattcaactaaacatctgctgaatgcgtcctaggcactaagtatgtattatcaaagctgttggcaagaacatcgctaacaggagcgtattttgcatctaataacgaccagctcacctcatgtttgtaatattttctattatttttgaaaactataatttttacatgcatttttttttataaaatatattatttttcattattttttttttattttttaaaaaatcatatcaatgattatatcaaactacacatgatcattcgtttctttaaaataacaaaaaaaaattgataaatgataataaattggtagcataatagaacacttgaagcagggagccttctcttaagttattcgatatatttgaatttttaaataattaaatgataaagcttattaaacaattcaaaagaaaaatatctttactaaagactgtttagtataaatataaacaagataaataaatatcttgagcactaatcttaattcctttttgttcaagaagtaatttagctatttctgtatgaccattttgagatgctaaaatgagtgctgttttaaataatttaaataatttccaaatattattttgaaatattaaattatcaaaacaaattctaaataaaacaaataaatatctttagcattaatatcaattccttcttgttcaagaagtaatttaactacttctaaattaccacttatagatgccttcataagcgctgtttgaaatattacacatgatctagaaatattattttgaaacaagaaattattaaaataaatatcaaataaaacaaatgaatatctttagcattaatattgagtccttcttgttcaagaagtaatttaactatttctatttcaccattttcagatgcgaaaataagtgctgtatcatctaattaaaacaatttccaaatattatgttgaaatatcaaatgattagtttaaatttcaaactaaacaaatgaatatctttagcattaatatcaattccatgttttaaaaagtgtttaaataattgtacatgattattctttgatgcccaaaaaaatgttttttcaaaaaattcagaaaaatttcaaataaatattaatcacatacaatcatataatttaacatcttcattttcaatcttaattcctttttgtttaataagccattttactactatagggtttccattattaagcagatcaaaaaaaagttcgtttttgataagttttccttcaaaaaataaatgtataaatggaagattattaaaacttattactgcagcttgaagtgaaagacttaattttgataaaccttctttcgctagaaacgataaaatttcatagttgatgtattttaaacattgtattcctaatttatttaaatctttatcaatgatgaagtattttctttctacaaatctttggtttctttcatcataaaaataataaaaaacgtcatttcgatgaaattgaattgctgtttctaatacattgctaattgtcgaattattttgtatgcataaatggataatttctaaatttccgcctgcaattgcatattttaatgtattttcaacatttgatccattaattaataaaaacttaaaacatttaattgatttaaaaaatgctgcataatcaattaatgaaacatttttatgattaacaaatgaacttttttcagaaggtgatggttcaattgtttgattaaaatcaaatttattttgtgctgacatttcttgtaattcttcaatattatcatttcgaagaatctccaatatatgattttctttttgattttcttggttttctttatttacaattcttttcacataataaaaaagatttgaaggtatcattttttgtttgttcatttcgttaagaagacattctgattcatttgtctttatttggtaaagataaatagttaacacattaagcaattttgaaaaacttaaattttttgtgtttgataacaaatttaaaaataaaatgtatagacttgcatctttattttgtgtagaataagacatataaatacactgtgtgatataaaactcataaagtagagaacattttggctgaacttctaatacttttgaaactttgtgagaaattatttcgagattattttcatttaattctaaaaacaacttttcaattttaatcgcttcatcaggaacaagctgtaaaactaatgggcttggtggtggtggtggcggaggaatatccataaaaagtattttagtgaattcactaaaaaggcatttttgatttcagatagaaatctggcatttttgatttcaaatagaaatggcttaggtgaagtaaaaaactgacgctttaaacaaaaaatccaaatttcttatcatttgtcctataaaattcgatataaatatgaatataacaatatgtaatgtatgttgatgcaaatattttgtataaactcaaataacatatttggaataaagataaatttgttttaaatatggggaacgttaagtcacttcatgttttcaaaaacaatgaaacgatcataaacaattcaattttacagtgctcaaaacgagttttactcttcttattctagtaaacttaattatttaaataagcacagaccatttatgattcacaacaccatattgtatgttgcgaagtttatcataaatcatatgagcaaatggcccaattgttgcatttggattatccaaatccactgggatatcataacatttatcgttatagataatcttatttacaggtgaaataattgcagcagttccagtaccaaatacttcaagtactctcttttcatttagcgccttaattaagtcacctattttccattcttcttcgctaacttttatgtccttttccatacgcgccaactccagaactgaatcccttgtaacacctggaagaatgagatgtttcgaaaccggtgctgttacgagttccttttcaccattttcgtttatccaaactcccataatgttcatcgatccgacttctgtaatatattcttctttcccatacaaccaaagcacttgctggcaattcttttcatgcgcaatttctccaggcataacagttataccatagtttggtgcgactttgaagttacctgtacctcctggccaagcgcgacaatactcattgcatgcccagagcgaaattggcttgaaacctgttgtgtaataatgcccgacaggagataagatgatgtacagaaggcattggtcgcatttcttcagtccaagtgatggcgttgtcccaatcattgttgggcgaatgtaaagcgagtatccttcttcatatggaacccaacgttcatcaacgcgcacaagttcaataatgcacttcattaattcgtcaggatcaggcgctggaagagccattcgtttcgcgctgttagcaaagcgaacgcaattcatgtcaggtcggaaaagacggactttgccttgcaaatcacgaaacgcttttagaccctcaaagattccagtgccatagtggaaaattgaagcttgcggaggtaaagaaatgtttgaaaatggtactatttttattgatttccactcgtggtcgtatgtggcaatgagcatatgatcagtgaaaattgaaccaaatggaacaccgtggagatcgggaataggcttcttttcgttggttatttctttttcgagacgattaaaaagaaacgacatcaaaaaaaatgtttcaggtgaataaaatataattttttgccgttgaaataaaattttctttttcgctttagacatgtctaatcagattgatttaatttaaatgttctgaattattattatatcttcttatagtctaatgatatattcagaattacatgaagttgtattttgctaacaaataaataatatttactatctttattacttattgtacatataacacaaaatattcatgagtattaaacacttgtatacttctcatacacgaaatgatcaaaagtttagaaacgccgaataatttccatacaaaataaccgatttttatatctttggtaacaaagcaaacattcatgtttaattacaccaaagtctctccaaaaatgactcacccaatgaaaccaaaacttatcaaagggttgagttcgttagattttgatggtcttatttcttatatcaaaaatggatttgctcaaaatactgtttttctaacaggcgctggtgcttctgttgccgcaggaatccctgactttaggtcacctggcacaggcgtttattcaaatcttgaaaaatataatttgccatatcccgaagcaccattctctattgattattttgacaataatccagcaccgttttttgaaattaagcaaccttttcttagtggagactttaaacccgttgcaccacattacatggcaacattatttgacaggcatgatcttcttttacgactttacacgcaaaatgtagatggcctcgatcggaaagcaggagtttctgaagataaattagttgaatgtcatggaacttattccaccaatacatgtcgaaattgtggcgataaatctaaacacgaagattacctcgaagagttcaagacaggcaaagttgtttattgcaaaaaatgtgggataggggttgttaaacctgattccgtattatttggtgaatcacttccaaagcgattttatcatctttatccaaatgactttgcatctgcggaccttcttattgttattggtacgtcactgaaagttactccatgctcattacttcctggatattgtcgaaaagattgtcttcgagttttgattaataaagaacctgttgcgacatatgaagaaaaagtcagcgtcgacgaaagacgaaatgttttggtcgatttagctgagaatagtcataaagaactgtttaagttcggtcatgttacaaatcgaagagatattttcccttcagggcgattgcgaagaaatatgcaaacaaataattgatgctttaggatggactgacgaatttaatgaaattcatttgtaaataatttaattgattatcaaaaagtgtaataaaaagacttcattttcattattgattgatgatacaaatttcctataaaacatatttttcaaaattttttatttgatgattattttctttttcttcaaatctaaattatcctcgtgtgtttgaaacaaatctaattagattgcccactttgtcatcactttattgggatcgcgttttatagcaatttcttttaattatctcctttttcatttagtaatttaactatttctgtataaccattataagatgctaatataagtgctgtatcaaatagtttaaatgatttccaaatattattttgaaatattaaattattcaaagaaattctaaataaaacaaataaatatctttagcattaatatcaattccttcttgttcaagaagtaacttaactatttctgtatgaccataataagatgctaacataagtgctgtccaaaataatttaaataatttccaaatattattttgaaattttaaattattaaaataaattctaaataaaacaaataaataccttttgcattaatatcaattcctttttgttcaagaagtaatttaactatttctgtacaaccagttgaagatgcccaaataagtgctgtataaaatcattataataatttccaaatattattttgaaattccaaattatcaaaacaaatatcaaacaaaacagctaaagattttgaacattaatatcaattcctttttgttcaagaagtaatttaactatttctacatgactattccaagatgcaaaaataagtgctgaactatttaatttaaataatttccaaatattattttaaaatcgaaaattattaaaataaatttcaaataaaataaaaaaatatttttagcattaatatcaattcctttttgttcaagaagatatttaactatttctgtatgacctttaacagatgctttcataagtgctgtttcaaatattttaaataatttccaaatagtattttgaaatatcaaattattaaattaaatttcaattaaaacaaatgaatatcttcagcattaatatcagttccttcttgatctaaaatgtattttacaagttcaatatttcctgatttagatgaataacctaaaatatcttttggcgtgtgatgctctttcataaaatattttgtgagatatatatttccaattcttgcagctgcattaataatatcatcgttaatctccattccttctttttgcaaatatgtaaagagttcatagttgttccatttgatacatttctttcctaaaaatcccaaatttttgatatcttctaatttgttttcataaagatatttaaagatatcatttcgatgaaatttaattgctgtttcatatgcatttttaaatgatgaatgattttgttcacataaatgaataatttcaatgtttccacctgcaattgcatatttacctgtgttttctacatttgcaccattcataagtaaatatttaaaacatttaattgaagaaaaaaatgctgcatattcaattaatgtaatccgatattgattaataaaatcacatctttcataaactgatggttcaattatttgattaaaatcaaaatcattttgtgatgatatttcttgaagtttttcaatttcatcgtttcgaattatttttgttatttcatttggattatgtccttcttcaatatatttcttatgaagttcccaatcattctttgaaagttcttcataatgtttttttatatactgtttaattccatagcaataatattcattaatttcttcttgcgtcatgtggtgtgcaaaacattcattggttcttttataatcaacctttggactctgaagaaatttattttcaaaaagataataaagaatatactttgattcttctgaatatttagaaagaagtataccttcaaatacatcaaaaatttttgatttaattttgttgttttcttcaaatatttcaatttgttttaaaaagtttgaataaatatcaaagtcattcattctgaacatggaaattgtatatattgtttggactaatataaaattgaatgaaataggatgattttcatcataaatgtcaattattgaatttgctgattctataatatttgttttagccaacctaaagagggtttgcatgattgattgatgaatttcgatatcatttaattgtttttgcttcttcacttttttatggtttgtcttcactcacgatatgtatcggctttttcattgtttttaacggtttgggtaaattttgaagcaattcaaacatcacatcacacaacattctgaaatcctatatgtaaactattcaataaaaaaagatttgccaaacaaaattttatgactgatttttccaaaattaaagagaacttatcccaaattgaagaacaagcaaaagaaaatccacaaatatatatggatcttggtaatttgttcttaagaggagaaggtattgaacatgatatcaataaagcgattgaatatttccaaaaagggtctgatgcaggaataaatgatgcatcatttaatcttgcacaaatttatcatatcggtttgggaggtaatccaattgatatcccaaaagccgtcaacttatatgagaaatgtgtcttaaatgacgatcttacagctatgtttaatttagcgatgatttatattgtaggtaaaaaaaaaaaaaaaaatattccacgtggtattgagttactcgaaacatcagcacaaaagggttttgctcattctatatataatcttgcattacaatatttaagtggagaaaatgttccctatgattgtcaaaaagcaattgaattattagaaacaggatcagaaaaagggtattttaattgcacaataagacttgcgatgctttatcgcgatggttaaagagattccaccagatttagggaaatgtggaagaattttagttgaatcagccaaaactaagaatcctgatgcattatgttcattaggagaatattatgaatatattgggaagaacacgagtcttattcaaaggtctgttgaatgttatgaagaagcaatcttaaaaaaatcatacacgttcaatgtataacttagcaaatttattagttaatacaccaggacattttgtgccacgtaatccgaaaagatcaatcgaacttttaacgaaagcttctgaattaggtgatttaaattcgatgaaaaaattagctgaaatttatagggaaaaagatccttataaatcattatattattatgaaaaaaggttctgaattaggtgatgatgattgtacttataacttagctttaatgtatcaaaaaggtgaaggaatacctaaaaataaaaagaaatctttagaattatatcaaaaagcagcaagtaataaccatgttcaagcattaactaatttaggtgttatgtatcattatggaaaaggagtcgaaaaggatttaaataaagcatccgagtattatgaagctgctgctaaaaaagacatttaaatgcaatttataatttaggtgtactttattcacaagatgaagaaatgaaaaaatattccgaaagctttagaatatttcgaaatggcaagaaagaaaggggacacaatggcaatgcataacatggcattaatatatttaaatggtaatggaatagaacaaaatgtacaaaaagctgtcgatatatgtgaagaattaattaaaatgaattactataaagttattgatactttaattaaaatttacgcaaatgggaaaggaaatgttgccaaaaatccaaaaagagctttggagttatgtcaatttatgttcgataaccaaaatttccaatttttagatgtcgctataaaattgttaaaagaagaaaacccaccaaataatgaacgaattttggaaattttggaaaatggcgcaaagcagaatgatcgattcgctttgatagaattaataagagtgtattcagaaggcgattttggagtggcaccttccgaagaaaagatgaatttctatcagggaaaaacttaatatgacccctgaatgcacgatttggtaaataaaatttctgattttttgttgaatatgttttagtgacgaaatatacacttgcatatgtaagtaagttttaataaaagatcaattttttcttctttcttagcatctgtaaaaaattgctttgaagtttacttgtcggaaacacaaaaaattacttttaacatggatgaaaataacacacttggagtacatgacaaaataaatgttcactaacattttccttgatataaaattgcttagtgaatttaaaatattgacagtatttcaaaatgagatttaaaaattattttgttttaaaacatttattcttgaaattcatattggatattatgataaaaaaaaatacttttgataagaattttttgcaacaaagcataataggactcatgttttacaaatccttggaatttgtgttcattgcttaacataagcctactatcaatttttttgataaagtttgtttgacatgaaaagtgatttcttcagatattttcaaagttttttttcgaaatgagtattacattttcacctactgaaagcgctatttttctttcatattttgttattatttttatacttattttagtaattatcatttgttgcattgcatttactattttgtctggaatacattggagtaaaattagatatgattactcaatagattctgaaaacattagttacaacttgtatattttatatgttatgactactatttcatgggtgtcaccaattgttcttgccttttttattataattttcttgattattccaatcaaaatccgtcaaaaaatccctggtaggatataccacatttatttatttatattatttttaattctattattcaatttatcatcagatatatgctgttttgcttattcagcaccaaataagtgttcaagcatcagaaatatccaaacacaaacattgcgatttgataaagaaacatgtaataaatatcactcaagcatcgaagcgttcttttatttatatgtcatttcatttgtactggatgtaattcttattttgtgtccgttttgtagttgtcctcaggataaagaaaaacaactttcagcgtaacatataaaacattatgaagataaattaacttttaatatgttgctatgtaaaccatcgcttattgtatttacttttttttatgagtgacatttttgtcgtaatattatttattttgttataaatcttgtaactcctcaataaaagttttattatttattaaagatctattattgttataatacttacatttatgagattttatatttaaaaattattttgaaaatttatgttttttttttagtcttcgctttaaagatacaagtatcaggttggggagcaccttatttacatatgatgtgtaggtttaagactttcagtagttgtattattaattctagaatggaaagaaatacttgcatttgctctattagctttacattgttatattatatattccacacaaagaatgaaaaaaaaaataattaaattaatgctttataatgtctataaaaaattttgcttttacactcaagaaatttttaattaaagattaccataaataaatgatagcttgtaaacgtaataatttttttctcaacctatttccctttacatttcatagccctttgataaaatctatttatatgagatgatgtgtggcaaattgatttgaggggagttaaaactgacattattttttgtttcatgttggagaaaaagagtaacttacaagaaaacaatcaaaaaccaggaacaaaagaaatgaaaatcattaaatcaattcaacaaatcatatttggtttaaataaagaaaatatttctcaagcagctcaatcaattatttccatatttgattatagttatccatattcatttaatattgttatgagtcattatgttattatctgtgttttttattgaaaagaatgatttcgatatatatttgaattttatgaaagaaattgaaaaatttcaagaaaccaataaagtcaaatctaaaatttttgatgtttttactaatttccttctttttgcaaaatttattgacctcgatccaaattacacaggaatttacaagcaaaaattatattatccacttttgaaaatgtatgaaaataatattcttgatctaaaaatattgtaagatgagaaaaatccatattttatccattatatgtctaaagaagaaatttataaacaaaaaaattttagctcttttaaccaaatcattgctaattatgaagaattatcaaagaatgattgggaacttcataagaaatatattgaagaaggacataatccaaatgaaattgcaaaaataattcgaaatgatgaaattgaaaaacttcaagaaataacatcacaaccaaaatttgattttaatcaaaaaattaaaccatcactttatgaaagatgttcatttattaatgaagaaaatgtttcattaattgattatgcagcatttttttcttcaattaaatgttttaaatatttacttatgaatggtgcagatgtggaaaacacaggtaaatatgcaattgcaggtggaaacattgaaattgttcatttatgtgaacaaaatcattcatcatttaaagatgcatatgaaacagcaattgaatttcatcgaaatgatatttttaattatctttatgaaaataaaattatcgaaattgatgatatagaaaaattaggctctctatgtattatgttttggaacattgaagctgttatggttttagagaaaaatggaatgaaaataaatgaaaatattctcaataatatggtaaaaattggaaatctttatctcattaagtattttctgaaagaaaatccaattccaaaaaatatttttgcatactctcccgaattagggaacattgaactcgttgaatatcttttaaatcaagaaggaattgatattaatgttaaagatatttatttattttgtttgatattaatttcaataatttgataatttaaaataatatctggaaattatgtaaattaatttatacagcacttatttgtgcatctgaatttggttacgccgaaatagttaaattacttcttgaacaagaaggaattgatattaatgctaaaaatatttatttgttttatttaatatttattttaataattttatatttacaaataatatttggaaattatttaaattatttagaacagcacttatttatgcatcttataatggtcgtacagaaatagttaagttacttcttgaacaaaaaaggaattgatattaatgctcaggatatttatttgttttatttaatatttatttttaataatttaatatttcaaaataatatttggaaattatataaattatttagaacagcacttatttgtgcatcttcaaatggtcatacagaaatagttaaattacttcttgaacaagaaggaattgatattaatgctaaatctatttatttgttttatttaatatttattttaataatttgatatttcaaaataatatttggaaattatataaattatttgatacagcacttatttgtgcatcttcaaatggtcatacagaaatagttaaattactaaatgaaaaaggggctaattaaaagaaattgccataaaacgcgatcccaataaagtgacgacaaaagtggttttgatgaataaaaatttgtgataagaagagaaacataatgtaatcgaagagatacagaggtagaatgcgctataacaatagtaataccaatggcagccccaatttcgggaccaagtgtacgtgataataaataataacatccgccttctttcatttctccattagtggcaataacacaaatacttgtaagtgttccaatggaaacacatgtggtaataaaataaaaaagaagactatagccccaaccaatgtttgaaatcgtacgatgtaaatcaaggaaatatgtaacacatagaagattataaaatacaggaataaagacaccagaaaaccagtggaaagtatgttttatattaatgtgatctgttaaatacagaaatttccatcatttatattaatatttatttaagtcacattatttttaatcttcattggagtctttttcttcaccttttttttctattcattataaaaaggacaagaaaagttattccatcaattaccacagcagcaattacaattacagcaattgcccaaggaggtgcatctgtataaacgacgacagtactactcattggttcaatacctccgaattttttatcaccgaaatttacggtgacaataaccctattattaccgaacactgtttgttgtactttccaatcatcagacaaatatttatgatcagtcatttcataatatccagttaaataagaaatttcttctgcagttttataagattgaacgaatctatttttatatctttcccaaattgtttgattaaacaaaaacattggcggagttccatataatcgattaaacaaatctcttttatcccattgaggaattactttcgaattatgatctccccaataccaataacttataacacaatcatgataaacaagttcgaacaaagggaattcgtaaagtttcatcaaccatatattgagtttcttcaggaacataagtaaacactgtttctaaatctcttccagagttaggtactctatattcgccaggactcatcattccttcaaagaaatcgcaattaggtatagcttgttctttaccattctctgttcctacaacaaatccacgatttgtatattcctttaaaaagttcgattcgtgcttctaatgacattgttcgagtcataggatgatctggatgataacattcacgataaggtgatgcaaatgtcgtatcaataaatcgtgttgtgaagttataaccagaagaaatttctttatcaagtttcttctttgcatattcaggcgctcttaagtcacataatactggacaaccaactcgtggacattcttcaagtgttgaacctgctggacatgataaattatttactgaccatgaagtaattatttgattatttttcatcaacaataacatcatcaggaaatgcatcataaaaaatatgctgtcgaattacttacataacctttgataatattttcgggatccatttgatcttgataaatatcatatcgacttgaaaggatattagtcatattattattcatataattaacttcactgattgatcctccacctgatgataatattcgttcgattcctaacgattgcatttcggtatataatttgattttattaatattaaaactaccaacagtccatacattaactgagccaattaatttatcaacgtttggacgagttttaattttctctgtaaatggtactaaatatcctttttcttgcgcatattttcgatatcttttggctatagaaacatgatttccttctaaaaagacataacgaagttttcgaggatatgaaaaacggcctttctcaagactaaatcgtggtttaatatataaatattcttcattataacggacaacggctactgaactatcataaggcgtttcaaatattattatcattgaactttgatcatttgtttgaccaacaaatcccattgataaactataaatactataataaaattcatcacgtccaagaagttcggttaaatcaacaggaagtgtgatgccttcacagtatggaagtacaatacgatctccaagtgaagagataaatggaaacggataatctggtggaagaatttcggagtcattgttatcaagagcaactgtagatcgaaatccatcctctaaaagttcaatattaaagtgaataagattatctggtgtaattgtatcaatagaaattgaactactggtcgtttttaaatttattgtagtgccaccaatagtttgtctacgttgagtcaagttcgttgagtggttttatcataaattgtcatatttaataaaagagtatcatatgttaatttgatgtttgaattttcaagttcgacatttcgaattgtgggtgcatcgtagtgaccagttatatcccactttatagatttaaacttaaaattggtaatattacttccgacaaaacgaaatgtgaaattacgtgaatttcctggaataatccattttctagtatatgtagtatattcgccaggtgaatcaacaactggataagattgaaatgaccaatctggttcattattaaaatcgtatggaatgatttgaaatttagcatctccttttatataaaaaacatcgccagtaacagttacttcatcaccaggatgccatgagatacgaggtgatgtaacagaataatctttttcaccaatatgtgaaaaagaaaattcattatctgtttgttggagttcagtttcgcaatctcctgttgaaatgccattacaccaagtactgaaacgagtaatttcagttagagaaaggaagaaaaacagaaacaccaggattgtccaaactgtaaataaggtaattcaatgcaagaaaacttttcactcaaaattcattatcgttctatagaaaaatccatcggcagctgtttacagcatcatttcaaagcattacacaactgtacaacgtttgcactttttgtcgtttttctccatgtaaattatacaagtttcacaccaaatatttggaaactcatgtccagaataatatatttgcttgcgaagtttatattaaagaagtaattacatgaggacgcatctgatgacctttccaaatgtttccatattcttctgtataaaacatcacagtaattttaattaattttttagttaaattttctcctcatttcatccaagttcagcgagattcttctcagacttctcgagtatgatacgtgctctaatgactcttgactcgagctccaatctcttgagcaaactttcctttgttgttccaactctcacgacagcgccgcccttctttgcagcttcttcttgtttcttcctttgttctctcttattgttcaaagcagtttctgcggagtttgctaatgcgtttgcacctttacatattaccactacgccttctctcagtgcctttgcttcaggtgactcattgttatgcggctttgcgaatttctctccgattccatttaatcctttcattctgtcgatgactaaagtttcgggttcttcgactttcttttcttgtgaagtaattttagttgacgcgtcgagtaataatttcatttgttcagttacttcttcagttaatgaaagataactatcgacgctttcttcactacttggatgtgccttcgcatgtaacacaacatgatttacagagtcgcataaagtgataccaattcctaacatgtttgtagcatattcacgtgagatacttgacttcattgtcttgactttatcattataagtttctaatgatgatttaacttgtgttaatggatttaatacattagtgaacttagcgttaactgcattttgtgctttagcttcttcttcggctatttctaatgccttttgcgcgattttctgtgtctcttcaattgcgttcttaatgttttctctatatttcggtgattgtccatcccaatcaccacttaacatgaatctactacgtaattccttaagtaatgaatcataatttactgcaatgttactacaagtagttgctaaaccactttgcaattctaagttcatcgatatagctgaaactcttaatgtttgtaatacgacattatctatagctgtatatacttcgttcattgaatctgctaattgtgcattctttgcattagggaataatccataaaatgctttagactttttgttgataaatattaatatattcatttaacttcttaactgaatcaataactttcaaattagcagtgtctttaggtactgatggcattacataacgtttcttaagtttttcggcattttctaaatcaggtactataggtacagcatcagttaacttattaataacacgtgttaacccaccaaatgaatcacttaagttaatgaagtcatgagttaaatcaaataatgccgaatcttgtttgtttaatgttggatttttagcattagctttgaattgtccaaattgttctttaatagtaacaaataaattattaaattctttctctgcttgtttatcagtatttaattgtaataatttagttgatttagtttctaattctttcatagatttctctaatttttcgacttgtgaattgaacattatttcaaatgtttcggggattttagattctgctctagctgtaatagttgaagataatgatttaattacatcagaagcaattctcatgaattctaatttagatttaccgatatctgatgtaggcttttgtttataaattgggatattagtatcttccataatatcaagcatcgaatcaaacattctattaaatgaacgtgtagatctacgaatagaagtagaagaaactgcagaagtcttaaggatatcaatcattgaacgtactgatattaaagaagaatcgaatattctaatacaatcattataaatcgaatcattttcacatgatgtaacatttaatccttggaatatagctgctatagaattagagacatattcaatgatttctgcaattgcttgagttttagatgatttatttctattttggactgattcaattaaattctttgtagatacaccaatcttttgcatagaattagaaataactttttggacatctgtagctgtcttaagtttttcaattaattcataaggattcttagtttctttattaatgattgtaattaaatctgttcgaagttctgttaatgactttaataattcaggactaatcttaccatgaattgcataagatttttcaactaatggtaatatcttaataattttaggttccatagctttaagatatgaatcattagtaccaaatgataatgaatgaatatttaatcctttaaattgaataatttctttgttcattaaaataaatatttaataattttttatttctaaataatatttgaaaatttatttacacagtccaacttaaagtattttcgccgttacctcttataaacataaacgggatgtcaatatcacttatcatttccatccacgacatgtaaatgtcgttatccaaattttcatttgggatttccaatgtcaaagcgatgaaagctgcgtcagagctatacttcttaatcagatcagttaatattaaacatttattattcattatatccatttcatttatattattataattaatttttttcattaattcattccatttatccaaagtacactttgaaatatttaaatcattttcatcgattataataatttctgcattaatacgaaatttatataatagtttaatgatttcgttttcattttctccattaattttcataatttttattacacgtaaattcaaatttttccattttttattctttaataataaatatgaaagtaacaaagttaatcctccatcatcaaatagccaccaaacatcgatattctttttattgttattaatttcagatattaattcgatgtttcttaagatacaaatcgaatatttcgtattcatagcatatttaatagcatcgataaattcattataattattataattaattacattttcattatcataccaaaactttggataaattaaacataatgtattaggtctcatcattcctattcccattaataataataagtcttgtaacccctcaacaaaagttttagatatagttatatcataaaatgtatgataattataatcatctgttaaataagtaccatcacgttcttctattaacttattaaagttataatcatttaaataattattagttataaatatacggccaacagataccattccatggccattcaataattcattaataaaatcaattgtgttccgtattaaatcaggatgtaataatgtgattaatattaaattcggtcgatatgtttttacatgaggtttaatatgatataaatttaattcttctttataagtcgaataaaagatatgtgattgagtaacagtaccccaattatcattaagttttaatcgcttatatatgtaccaaatgattataaatatgataataaaaattaatgaatattcccattttattaaaaacatacgaatgatacagatgatcgataaaaacaatgaaacatatcgattataaaatgtaaaagaaggtctaaatcctggataatgtgctgaatcagcaatatatactgtaagattgataaatgaaaatggtatcaaaaatataatatttgtaatttgcgttaataacgttggattatctataaacgaaaataataatgatattatagtaactattaaatgacaacttaaaaattcgttcttgatttttatcttctttaaaaatttgggtaataatttatcatttattaatgttattaatatacgtgtgccaccagtgttcattgtaattgatgaacaaattgatgaacaaataaaaccaatataacctaaaattggtacagctgagttattaataaacaaaaaactttcatcacttgttatattaaatgatgatgattgtaataaaattgttatcaatatgattaaaactgataaaaaaatagcagaaaaagctccaataggtatagatttaccagtgttccttaaatttccactaaaattcgcacatgtcattactgcatttgacgcaggaaataaaacacctaaaaattgtaatatttgccaaacattatttatcgaatgattaaaattttttattaatgtttcagtagataacccagtaaaatatgttggatcaccaggcttacgaataaaaaaccctaaaaaattactaacaatagaaattaataaaattggcgataatgtcatcagaaaaattatgataaatttgatcgaaggaaggcctaaaaataaaacaatgatgtttaaaagaaattgccataaaacgcgatcccaataaagtgatgacaaaagtggtttcgatgaataaaaatttgtgataagaagagaaacataatgtaatcgaagagatacagaggtagaatgcgctataacaatagtaataccaatggcagccccaatttcgggaccaagtgtacgtgataataaataataacatccgccttctttcatttctccattagtggcaataacacaaatacttgtaagtgttccaatggaaacacatgtggtaataaaataaaaaagaagactatagccccaaccaatgtttgaaatcgtacgatgtaaatcaaggaaatatgtaacacatagaagattataaaatacaggaataaagacaccagaaaaccagtggaaagtatgttttatattaatgtgatctgttaaatgacttgaatctttgatattaatttcggatttggacgtccatagttttcgatctggtgaattatataaattagcatctgtaatgaattgaggacttgaaatgggattttcacttgattcagattctattatattaggattaccatcttcaccatgactaattgaatcggaaagagagtattcagaatcagttgaatcagaaaattcgaatttttttagttttcctcctttccttcttagcattcaagattggtgaacgtttaaaaatttatgcaccaaaaaacattataaaagaaatttaaaataatatgacgatttaaaaatattatgtttcatctaagtttttggagaatgatatgatttattattatagctaataaatataatcaattttatttagaaattaatcaatgaaacataaatcgaatattttcattttttaacatttaagaaaataggtgaacgcatttaaaagaaaagacttataaaataaaatcatggaaatagaagtttattttaacaagagaaaaccaaaacattgataaaaaaagtacttttttattaattatataaaataatcgtatcaaatttaattccaattgttatattcttcataaaggaaattctaatgaagatatttctgtttttaataatgttaaatcccctcaaaaatgccacttttataaatttgataccagcttaaaaagaaaaatttaagtaaagtggctttggtatttgttaatatgtttttctaatttaagtattacaagtaagaataaatgtgttgagggataaaatttacttaataaacaagttaaattaataacttagaagattttcatcatataaatcctagagttttttagtcttcttaaattcttttttttatcataaaaaatttatttttaaaaaaagtttgaaaaaataatatatagcaatgacttcaaaacatatttcctctgtttatccgttaaaaatattgattgtaaactgattatctaaatcaaaattttcaagttattttaattttcaaatatatgtatctaaacaggttatcataatgaactgtcacatcgtgtggagtgtaattgcaccagcgcttgagtatttgataaatttaattttaaattttaatgttcaggggaatacgtttatttgattgcaccttcccattttaattatcgaattttgaattggaaaatttaagtaaattttacaacaactgtgaacaattgtgttgaattgaattagatttcagaaaattatggggtccgataccataggttgtgcgctatcatcacaaataccaaaccccctcagaaaattctgtgaagaccattgaaaatcaacgtgtgattcgaattacaacgcattcaaaaaactgctttggttgtgttctcttaaataacttgactttttgaaacagttgaaggtttggggaatcggaactgagtcagtcggttaaattctttttaatgtcagccatgtttaaagaaaaaagaaatcgcgagccacagaaagtaagatggactgaagaagaagacaacttacttcggaaaagtgtacagaagtatggaccaacaaattggaaacgtattgcagaagaactcccaaatcgaaatggaaaacaatgtagagaaaggtgggtaaatcaaataactccaggtatcaacaaaaatgattggaattttcaagaagatttattgcttgttaaattatctaatatctatggacataagtggtccacaatatcaaagttctttgctggaaggtcagttaatgctataaagaatagatggacatggataaataggcattcaggttatgtaataagtttatatcatgcaattaattgcggaaacggtattcacccagaaacactcgttactgagcctattaatactgaaaacagctttgcgttaaaaggagtgcaggagtcaaatgaacaacaacctgaacagccaaagcctccacgaattatattcccacaattagcagataagattgatttcaagtcagatcaattgcgaaaattattagaaaatgtaaactagttttattattattattatttattcattcaagaaatattaaaccatatacatataaaaaataaataaaccaaggtgcttgatttgtgtatctttttattcatttccaatctgatgaaagagtcatgggctctcgatgattttgtttttttatccacatccataattcaataagaaatatcgtttccattgaaaaacttttatcatttcattgaaaattctattagacgttccttaatttttcaatgctaaaattttactctgggcctcaggcagataagttaagaaaattgaaataaaagtacaatttctgttgtaagcccataaatataaaaccgttaaagagcaaacaaaatttgagagtttatgtgcgtgttttgtaagtttttctgagtttatttggctgcggtacattttttgtgctgactctatttcttgggtttttacaagaaatgattgatgttaccaaatgtataaaattgttatgatatttaaataactttggataagtttaaatttctatatattaaaattacaatctttaaatttttaatgcagtcattatcttatccgaaactgtaataagtgtatcaaaatttcaatatcctcatctttttattgaattctctttggttggagttatatggaaaaacattagagatatttttgatatttactatactttatttgaaaattgaagaaatgactatttccttaaaatataaaattttatccatttctgatacagatattatttacatgattttaagtaaagtttattgttacatatctattataatcatgaacaaagcaaattagcaatttagtatttacatgcattatacaatttaaaaagaaacataagaaaacatttcatataatttttattaaaactttttaaatatatctccccgcatttttatgatgtaaataatttcctagtaaccacattatattttgctgacagttttacttttctgtttttgaattaagcatcttaacaacttcagtatcatgtttaatcaaagatgttgtattatacaatattaataatttccaaatatctttatgaaataccaaattattaaaacatgtattagatagaacaaatatgtatctttcgcattaatatcaaatccttcttgttcacgaagtaatttaacgatttctgtgcgaccattttgagatgcccaaataagtgctgtcttaaataattcaaataatttccaaatagtatattataacactaaattatttcaagaaacattatctatagcactgatatcaatactttcttgttcaagaagtaatttaacaatttctaaataacctttttctgttgcacttataagtgctgttttaaatatttaaaataatttccatatataatagtaaaatattaaattattccaagaaatattatctctcgcattaatatcaattcctttttgtttaagaagtaatttgactatttctatatgattttttgatgttgctctcataagtgctgtatcaaataataataatatattccatattttataatgaaatatcatattaagtgaataatttttatctttaatattagtatcaataccttcttgtttcaaaagcaatttaacaatttctatatgaccattttgtgctgcaaaaataagtgctgttcgaaattatttaaaaaactcccaaaaaatattattaaatatataataaataatataaactatgaataaaacattaaaatatttttaacattaacatcaattcctttttgttcaataagtaatttaactatttcaatattaccattcatagatgctataatgagtaatgtattaaatattttattgaattttcagatataaattggaaacataaaatttcaagaaaacaacatttaatgaattgaataaatatttattatatatatataaatcgagtattaattctttctggttcaaatagtaacttagcaatttctgtatgaccattttcaattgcaatcaaaagagcttttccaaataatttaaataatttttaaatattatttttaaatattaaaccaattaacaaaatatccccacaattagcatcaactcttttatgttcaagaagtaatttaactatttctgtataacctttttcagatgctgacacaagtgcattgttatataattttaaaaattaccatgtattatttttaaatatcaaattattaaaataaattctaaataaaaataacaaatatcttcggcattaatgtcaattccttcttgttcaagaaaaaatttaactgtatctatatatcctttttcagttgcaatcataagtgctttttcaaataatttaaataatttataaatattattttgaaattccaaattaataaaataaatttcaaataaaacatataaatgtctatattattaacatcaatttctttatgttcaagaagtaatttaactatttctacgtgaccattttcagatgctttaaaaagtgctgtccaaaatatttcaaatagtttccaaatattatttttaattattgaatcaataaaataaattccaaatataacaaaatatccatatgattaacatcaattcctttatattcaagaagcaaactgactatttctgtataacctttttcagatgcaaacacaagcgctgttttaaatatgttaaatattttccaaatattatattaaaatgttaaattaataaaatacattctaaatatgacaaaatatcaatatgattaacatcaattccttcttgttcaagaagtaatttaactatttcttctttaccatttgcagatgctaacataagtgctgtatcgcataatttaaatataatcccaatattattttgaaatattattttaataaaataaattttaaataaagtatatatacatatttaaagttgatatcaattccttcctgttcaagaagcaatttaactatttctaaatgaccatttttagatgtcaacataagtgctgttctaaataatttaaataatttccaaatattattttaaaataaaaaattattaaaacaaattttaaataaaataaattaatgtttacagcattgatatcaattactttttgctttagaagatattcaagaagcaatttcactatttctaattgacctttttcagatgcatgaatgagtattatttcaaataatataaagaattaccaaatatttaaagtaaacatctttctcatttatgtcaattccttctagttcgaatataaatttaagcaagttgatgttaaatgcttcattatttgaaagtaaaaacatgctagtatgtaccttatcatattctccaattttgttttcataaagataataaaatatatcattgcgataaaattcaatcgctgtttcatatgcatctttaaatgatgaatgattttgttcacataaatgaacaatttcaatgtttccacctgcaattgcatatttacctgtgttttccacatctgcaccattcataagcaaatatttaaaacatttgatagcagaaaaaaatgctgcataatcaattagtgtaacattgtttttattaataaatgaacatctttcataaagtgatggtttaattctttgattaaaattaaattcattttgtgatgatatttcttgaagtttttcaatttcatcatttcgaattatttttgcaatttcatttggattatgtccttcttcaatatatttcttatgaagttcccaatcattctttttaagttatttaagaaatattgatctttttttagtaacattttaatttttgcttctaatgaataatgtgcaaaatataatgtttcagtattttttaataaatccacagatattaaatttgatttgatcatcatctcaagaagaaaaaaagattcatgagaatacaaattgagaagataatgtgtaaatgtaattattatattaagttctttgattaaattcaaacataaattcacatctttcatttgtgaaagaaatgcagaataaataaatctactgagactgaggtcttcaaaatctaaaaaattatctccaaggtaattagttatttcatgaattgatttaaaaaagttttcttcattcaagtttaaaataatttcttcaagcatttgtaaattctgcatccacttgcttgagaaagggttaattggtaatgttgtatcatgctcatttggaacatttggtttactagatcgatttcccattaataaagatttgacaacaaattacttaaaaaagttcgaaagtgacattaattcaaagatattaatctcattaaaattgtaccaaatatttggaaataggattaaagcttatgcatagaatgtaaatattttgaaatttacttaaaaacatgtttaatgatttagcttgtttcagttttagttgccacattgcggtcttttggcgggttcctgaggcaccttggcatctttggcatttccttatcctcaaagttgtgatgtacacgagcagcggacactttcgctggtgctgattccttcttaatcgaaacccattcatctttgccttcattttgtttattttctaatttgatttttgcattatcattagaaatatttttaatcgaaacccattcatccttatcttcattctgtttattttctaatttgatttttgcattattattagaaatatttttaatcgaaacccattcatccttatcttcattctgtttactttctaatttggcttttccatttgtgttagagatatcattgattgatacccattcatccttatcttcattctgtttgttttctttttcggtctttccattatcattagaaatatttttaatcgaaacccattcatccttatcttcattctgtttgttttcttttttgacttttccattagtgttaaagatatcattgattgatacccattcatccttatcttcattctgtttactttctaatttggcttttccatttgtattagagtcatctttaatcgatacccattcatcttttcgttctgtttttggtattttgtttgtcttttgttcatctttatcattattttgtttattttcttttttggcttttccattagtgttggagatatctttgattgatacccattcatctttgtcttcattttgtttgctttcttttattttttctttattattttttgtaccaattttagcgatatctttcgttgatacccattcatctttatcttcattctgcttgttttcttttttggtttttgcgttattattagagatatctttaatcgatacccattcatctttatcatcattttgcttattttcttttttgatttttgagttattattagagatatctttgattgttgtccattcatcttttcgttctgttttttgtttatttgtcttttgttcatctttatttaatttttcttgtgtttccttttttattatttgcgctttatcttgtttacttggcatttcttctgcctttgcttttgttgttttgttaattctttgttcttgtttgttcattgtttcttctgtttctttcttcattgttcgatttgcgttcacttgtttcggtgaaaattcttcgaatttcttcctaacaattctattatttgatgtctcttctttctttatcaatttctgacgttcttttgtcgtgataatttttgattcattttcttcattttgatttatactttttcttaaattatttgttgttgaatttttatcctcaatgttcttgctcctgaagctactacgtactgatctggcaccagaacgagctgaacttgatctccgttctgatgaaagaacaggaattaatgttttatatgttgagttattggttgacttccttggagaacttggtggggattggcaacgcgctcgcttggtttcggaatcaactttttttagagtttcctttggtggatctttggatttacgtgaaattagagatgtacgttgtcgagatttggaagtaggcgttttgggaatattactctttggtgtaattgtgtcaaaagttgaaacttttccacgagaatttgaatttgaaacttttgaattcatacttattgattttgattgtggtgatggagaagggatgtgtgaccttttgcgtggttttggtgttgtttgtttattttgttctgttgaggcttttgattctgcatttaatcttgaattttgtaaaattaaatcagcctgtttcatgcatgcatgaatttcagataaaaaatcatcgtaatattttaagcttattttcctggcttcagatacgttttcctccatctttgttgccaagaatacgttaattgctccaaaaaatgaaaataaaacaaataaatcataataatcataaatacaccataaacctagaaaaaatgagttcaatatctacaagagcaagagaacgatttggaatggattcgccaatttttgataattattctgaagaaattttttccatgtttttagatttatgtcaatcacagcctctccaccttaccaataaatctgctgatccagcgctaattcagatcatcgaagaatggcaatgtcctgaaatcctttcaaagctagaaattcaaattcttcaaactaatgatgtttctcttcaaatttcatttttatcaatgtccatgtctaaattccctcaaattctttctgaaattacaacaaatttcacatcatattctcaacaataccctcaattattatcaatgaagcctcaacttctttcggcgatttacaaatcaaataaacaaagttactcgggcaaagaaatcattagtcaacttataagcattcaaaatcgattacaagatattaatgaaaaaaagcaaaaaacagatgcaaaaatcgaatcccttcaaaaagatattagcgcttgcaaagaaaagatgttaatttctgaaaatcaaatcaaaaggaaacaaaatgaactaaaatttttatcgaagagagaagagttgaaaaaagaagactcaaacaaaaaactaaacgatgttaaatatttgttacagcagcttaatgctgaatacgtacaaatttcatcactggagcaagaaatacaaacgaagaaagaacatgtcgaagagtacagaaagcaaacacatgaaattgaagaaatgttgggtaaaagtgaatgttaaaaaatttaaaaaaatgaaattgtttgtaaaaatataattgatgattttttttattttgtagtgctaatatgcttgatataaaatggagaaaaaagtttttgatttgaaagatatctcgaatactcttttttaataatgacaactctcgaagacaccaattaacgctctttctttgtgaagatggggtttcttctgaaatttactttaaaaaaatagaaaacaatgttggattgaattgtgtcaaataaacatatgtttgaattgcttttgtgcaagaagaagagcttgttggggacaatgaggtttgttagttcgtgatcaataaattggtagttttggtccaatgcaagaagtccatagttaacgtacggctttgttgctttttgcactcaaattttctgggacattcaaaatttcaatttaagataattttcgaatttttggcaaatttgaaaaaaagccaattttcaaagaataacatatattatatttgatgatactttgtatttatatagtacaataaaaattaataagatgtttaagcaaattaatttgagttgaacaatatgataatgaaataaaactgttccatttacatatcgtttcatttttaaaacattttatgactctcaaattttgagataagttagatggtcaagcatattgaaaaaaagttgaactcaaattccattttatggattgtgtttcaacaacttcgagccctttgaacaaaagtaaaagtataaaacaagattaccagtttcaaggtgtgttgaataaccaaggaggtgggcatggtaaatttaaaaaagtttatggcccaatcgcctccatggcaaagccactcatacctcgcgaagagtatttttacaagaacattaagaacacccccctctgccaatgtttgcctatcttcttgggctcaactgtttatgaggataagaaatggttaattctccaagatttaaccgcaaacatgagttcgccttgtatagcagatattaagcttggaactcgatcatttgaagtcgatgtttctcaagaaaaggcaaatcgccaattctcacatatatttaatacaacaacagcttcttatgcaattaggtgcatagatatatgcatccgacgtaatggagaagttgtacaccattgggatagaaaagaaggaagacaaatgactgccaagaaatttgcacatgttttgaaaacttttcttaatggaaaaagaagaacgcaattcgttcgcgcgataaagaacatttccaaaaagctgaaagaaactcaggcaattcttcctaatatgagactttactcagcatctgtccttgctgtgtatgatggtgatgatgacgaagctccgatgaatgtgaagcttattgattttgcacatgcttatttagatgttgaagctgaaggaggaaactcaaaagatacttcttatgatgataattcaatcaaaggccttaaaaacttgattaatttcgtcaactcggataattagttatagaaataaacaagtactattgcgtaatttattgtcactttaaaccgattttgactttttgaaaacaaaagtgcttttgttgaattactaaacagtatttaaatacttgtagaagctttcacaagtaaagtagtgagcaaattgaaatttactttgacaaaggcatcgtatttatgtgttaaacaaggaggattacttaaaaaaaaatacgataatttcagtttcaaatttagaaatattttgaatctattttgatcgtataaaatctcctcactcatgacgttggtgctttgatacacatgagatttatattttattattttgttcctcgttatatctacatcaatctaataatttcaattctcatttgattaaattttaatgtaaaatgatgtattctttgatcttattagaatgttatgactcaaaatatttctaaaactcaatgtcattcatgtcgtaaatgaaaaccttaatatgacattttcagggtttcacaaaaacatgtgtttttttattgatttttttgtttcttttaatgatgtaaccgatggggaaagtgacatttaggtttggcgtacgtttaaataatcacttttttgacacattgaaacatcgaattattgaatattaattcaaagtttttacgttcaattatggatactttactcaaaattggtaatccaaaaaatgaattcaaccattccaatccaagtcagcgatttcgaagaaatagctaaatgtttctatcaaaatacattagaatctgaaaaatcacgcgaattaattcaatccttatctgaccagccatattcattatacatttttcacactttatttacggattcaacttctcaggaagcaaaatacctctgcctttcagctattgcgtctaaaataaaatcacaatggaatcttttttcggaacaacaaaaatcacaattaaaaagtttttactttgatttggttcgagaatggccaacaaaagggttaaatattcaagttcttcgccaactagatagtgtattgattcaaatcctatttgaagaatggcctgaaaactggccttcttttatttctgatatcatagctatttctaatgaaaatcccatgactatgctcaactgtgtttacttttttggaagtttctcagaacaaatacgacattccaaattaattgcttcaaaaaagaggcaattgattttggccttatatcaaaattttcaaataatctataactttcttagatttgcttttttgcaagaaaacaatatggaagaaatcaaaattgaatcattaattacgttatcccaatatctcgaatgggttgatcttaaatttgtagaagacgacaagatatttgattttttctttagtgatcttatgccatatccacattttcgaattccaattcttaaatgtttatcatctattgtttcacgtgaaagagctacagcaaacccattaattgtcacgctatttaaccaatttatatgtctactttctaatgattcaaccatgttaattgacaaagaattagttccatcacttgtaaacattcttataaagtttgtaacgttagatcgatgtgcgttgatgccaaatgacactgtaattcaatggatgatagaatatacaaaaattgttgatgaagaactttttgcccaaattgttgacatgtggcattaccttgccaaggtatttatttgtgacacacaaatgcttcctttctcaaattgtttcttgttcccactgcagcagtcattatgtggtcgcatgtcaaaaccgcccgagtacgatggtgacaaagaactctttgataagatgagcgaaactcttttaattctatttcgggtacataaagatgaaattctaggtgctattgtcgaaaaaattaatggaccaaattatgatgaacaaatgttaccaattatatattcaattggcgcaatctcaggtgtgtgtggagaaaacgaagaaaaggcgtttttgtctattatcattgagtcattattacgatttatgcaaaataatgatgaattttcacctcaaataactgccgcatttatgtatatagtatcattatatcctcggtatttagcaaataacttgcctattttagaaataacattatcaaagcattttgagtattttgtaagcggaaatcaatttgcccaatttgtagccgtcaaaacgtttataaacttaacaaaaagttgcgggaaattgatcgttgataacggttattcgaatcaaatatttgagcaaattgatgttcttttacaaaaaatccctccttttttacatcaatcattttttataagtttaaaatatattgttaaaaattgtcgagatgaagccgaaagacaaaaaatgatagtcgttttattaaatcatgcaaatcgaattgacatcataacagaattaatatcaattgttggaaatgattttcaacaatcgattgaacaaattattcaaaacataataaatgattttaagaacacacaaaatgagttagaaagacatcaattatatgaattattccaagaatttctaaaatcatttccacaatcatcttgtatccccacattagttaatgaagtttattctgattttggtaaatttcattcttttgaagcatttgaatttttttcaatattaatcaaggaaggcaatgtcgatttagtcccatatttattcaataactttttggcgccaacttttgaacacatttcgaagacgtttacggagtaccccgaaatacgtttacctttttataaattaattcgatccatttttgaatacttctttcagatacctcgcgaaatgtttaattgcttatttcattattgtttttatgggatgcttcatccacaaacggacatatctgaattatcgttcaattgtgtttcaacagttttattgcaattagattcaaacaacgatttaaatgtgattaatgacttttattcaacgttttatttcgaactaatatcacaattctttgatgtgatgtttgacggattacattctttcttgttctcgcaagtcacgcagtcattgtatcatttgctccaaattgcagctgccggaaaattaaattttttggacgtgaccaaaatatttgatttcgtcttccagaagttggtttcaacattcccaaaccttacccaggatgaactaaggtgtatctccggagaaataataaacggggcgcaaagctgcgaaaagttaagacaagtgatcaatgacttcataatagtgtcaagacagattaatttgagcgatggaaacatattgtcatttgatatagatgaagagcaagcggactaaatgtgtgtgctcgcatggatatatgtatatatgtataataaatgttttgttttttataaattatgaaatgaatgtccattttatcttacaactctattagtgttctgatattttcataagtgtaaatcactttcaactttatgaaattctaagatactaaatttatttcaatgccattttgtacaaaaataatttctatccaaatatttgaagacaagcattcaaatacaacttctacaaaatgatattaaaattttaaaatatgagtttcaaagaagtaaattaattgttgttgctttgtttctgtcgaaaatataagagaataggacaatgataaaacatggactattcttattacatacttggaatagcttaagaattccaagattaattagcgtttgttaaaatattcgaatagtttataaatttaaatgaaaaaatcgttttttttttttttgttgttcatttatctagaaaataaatttgttctttctttttgaataaatcgctttgtttggacatatgagtcgcttttaaatcactgctgaatacaagaaaggagctatcatcatcaaaaaacaataaaaaatttttttaaaaatgttcattgcttatgaagataatttatgtgaaaatgttttttaatgtatcagattttaatttgactgtaaaaggcagttggattttaaaataattgaaatgactatatagaaaagttgataatttcatatgaaagctcagtattgaattattgttgtattgagtgattttgatcgttttgtgtgtaaaattgatatgattacaagaatattttgtatcaagctaaaagcgaaaatgagaagaaaacattatcatctcacttatcattgtttatgactcatattgattaaatttttgatgacacttgcaatttcagatggaaaacaaccaatttcatacatttttgatgaaaatttgaaggttattagtttgagtcaaaatcaagaatatatcttgtaattacgatcgtcaaattgatgaaaaataacgaaatatgtatattagtgatcttcaccattcatttcattgatcttatatccaacatatttttcgatgaaaaaatttatcataaaaatataaaatatataaatttcaaaaacaaaaatgtaacaacaaatcaacttcaacagaacaaatatattcattatttgtcaaatcataacaaaaatcattcaaattacaaaatttcatttttctcatatataaagtaccataaaataagttgcaaatattatcatttattaagtcatttatttataacaccatttgatattatgaaaaaatgtttcgaattaattactttttataaatttaaatatcactttatttatactttgaagaaaatttcgatttattttgatatttatataatgaataaagtaaaaatattttattttatattgaggaatttcttatattacatatttaaatcaacaattaacaatttatatattatatcatttttaattatatttaatattctttttcaatttattaaatatttttataaaagttatttaatttatgataaaaataaacaaaatttcaaaatatttttgattttaatgattatattttttgttaatacaaagcaatcatgtgacgaagagacaaaaacactcacaatatctgattccaatgattattcaaatgattatatgaatgttacagaacacattataattattgatgttggcgagcttgaaagtaatgcattcagagaatggcctttattaacaacagtaataattggagaaacagttgaaaatataaatagtggagcatttgcatcatgtacaaaattagaatatgtccaatttccagataaattaatgagtggaattggaggtggtgcatttgcagaatgtatttcattaaataatattacaattcgttgtaattccattagtgataatgcattttataaatgtacaggacttgaaacgataactttatatgaaggcgtacgaaatattggcgctgatgcattcagagggtgtacaatccttgtgaatatttatataccaagttctgttacttcaattggaaatgcatttttagaatgtacaaatcttcaatttattaatgtttcagatgaaaatattggatattcgagttatgaaaatgatggcgttttatataataaagaaattacacaaatcattagttatccgaatgggaacagtaaaacattttcaattcctaaatcagtcatttctattatgaattatacatttgcttattgtaataatttagaaagaatttttattgatgaaaatgttcaatatattaattcatgtgcatttgttaattgtacatcacttcaatgtatttattttaatggagaaatttcaccaaaaatacaaaatgatgcatttgttaatataaatgcggcaacagttatgacaatagaaacatatcaaaatgaaacatttggaaatatggaaattactaagggaacaacacttgacgcatgtctcccgccaacacgaacatttactgactcaaatacatttacaattagtaatacatttatcaaatcaaatacatttacgaaatcaaaaaatacttttgagtcaaatacttatgttgatacattttcgatgaattttactttcgttaacacttatactttaacttattttttatcgtttataaaaactttatcaatttattattatacgttcttaaaatcttattcagttactttcattgaatctgaaactaaatatatttatgtcgattttatatattataattatacaattatatattatccagaatattttacttattattcgaatttcttttatatttcttatatcgaagatgtaataataaacactgatgataataatacattaattatcattataattgttgttgtaattgtaataattattgtatttgtattgataatcataatatttatgattaaatatcaaaatatgaagcgaaaacaaaatgaagaagaaatgaatttttcagatgaaaataataataaaattaatgaaatagataatacattttcagttgggaataataattcaaatattgaagaagatccatttgcagtcgatttcaaagaagaaaaatttatcagtcagatataaataaacatattttaataacaaaaaaattttttttatttattaaatacaaacatttttgttatttggcatatcttatgttttctttattatatattttatgcttattatagcaaatccaatagaaacattaaattttataaaattgtttttttttttttcaaaatctttagcagctttgaatgtataatattgtagaggctaaccttgcagcatatcatattactcataaatatttcaaattgtgacgcacatattttttgggagccgccaaaatcacttttatcgaaaacaaacgataggaggcatcgatgccgaaaatctgattaaaatcgattcaaaaaattctatttctgatgtttacaaataattgcgtgatttgcttatttctttttgagagaaaaccgtccccttagttccctattttgagcttttgatttggtgaacttgtgggaggcaataattgcagggaaacaaatacttatttgttaaaggaattggagtttgacactaagtcgaaaaaaagcaaattagacaatgcatgtttaggcagttgttggaacaccgattttggcggcaagtttaacagggagacgatgcttatcgaatttatatccggatggaacaacaacaacatcaattccatcttttaattcagaaaattctttaagttgatgcccagatggagtgaagagtgcacgtacaccttgaccacatccacacttttgtgctaagtgtgttaataattgttcccattttctaaataatgttggtttgatttgaacattgactccatcgcagttcttttcaccaagattccagaaaagacatgcaggtggacgtgatgcatccatatcgaatgctttaggacctccaggaccaactctctttggtgcgcaagtcatgtgatatggcaaattcgaacctttcttagaaaagtgatttttttgaataaaatcctctgaaaagtctttaaattgacaactgatgatatatcagaaaaagttacttcattcaaataaaaatttgttcgttactttaaatgcgcaaacgctgatgatgctacaacaatgagttaaaaagatctcatgtttcaccattttgtttattcagatggaaaaatctgaagctcaacctcaaagaaggtcatcaacaagtaatggctcaagttgtgcaaaaatttctggttcattcttttcaccttcttgtggctttccgtggaggattggaagaagtggccatgaatcaagtttgacgattgccttctttaatttctcaatatattcaccttccttttcgacaacttcaggactgttagcagaaggataaagtaatgtacgtgttgctgtgaaaccgcaataacggaattgataagttgatgaatataatattgactcaagtggagcatatcctcttgaggcaaaatgagctaatgtaccaccagctgtaattataattgatgccttcttgcctttgagtgggcctttctccattgtttccttgccaaatgcgaacccaattgtgaagcaacgttcgaaccatgcataaagacaagctggtaaacggaagaagtacattggtgcaatgacgacgacgtggtcacaccatccaatgagttcttgttgtttcctgatggtttcacataagttgtcagctggtaactggtttccgatgtagttgaatttgtttggatcagcaatcttcttaaagtcatcaggtgtagcagtccgatcgaaaccttcatgaacaagatcagtgattttaacttcattctttgctgcttctaaggcttctttgcaggcattagcaaacctgtatgctgttgcattcttgtttggatcgcagtgagcaataacaataagaaccttcatattaaagagtgaaatgatttttgcgttggatcatcctctcaaattttatcgtaagtagctacaataagtggtcttgcggttttttgtatattattatctcaatattatgactttttcatagttcaacttgtgttgtagttattttaacggttccatttacatagccgttggaatttttctttgcttatttggttatattactttttggtgtaaattttccaaaaaaatcatgtttaatgggcgtaattagtagtggatatactctagaatgttaacatgcaagagatatatctaatttacactttaaaataataatgcgtattgattatttatatattttctttccaattatgaattattttcattcactcattataatgtgagatttaaggagcttttgttttatcttttagacaaatttaaaatttatcaatgaatttattgaaattaaaataatggaaactcattattatacaaatttgctattattcattaattgctcataagaattatgctgttgataatactttcattattttagaaaaaatatcatcaaatccacataggaaaatgtgaaaaaaatctcatcattaattaaataatatctgcaaaacattcaatattctgtagattcattttccattacaaaacatattaaaaatttttgaacgcacgatcgtgcgttgttatgacaaaattgcttcatgcgctaaaaagaatcgatctttgtattaaaagtatttttattttacgaatttttgaattataaaaagcattatttgcattattaaaaaatttattacaatggaaattaaaattataaataatccaaaacttttcagataaatatgtataaatgatgcaaattgtatttgcaaagcggtaatttggtttttctttaggagaaggcttttttgtaaagtgcccaaataaaccgccatcctcggtcaaaaaatttcagaaaaaatcattgcccaaaatgacacagttctcgctatttgaaagaagcatcaatgatcttatggtccaacttgacggtgaaatttccaactattcttcacaaggaggaaattctgataatcagagaaaaattgaaaatttattaaatgaattaaattccaacatggaagagctcgatagagaatctattttaatggatgcagatgataacctgcgtgcagtcaagttcttaaaagaaattagacaaaaaaagaatacaatggaaaatagatacaacatggctaaaaatcgaaatgaattattaggatcacctcgaaatctggatggctcttctcaaagtcaacgtgaccaacttgtatcgcaaagagataaacttaatcaaggctcagcactccttcaagaaatgcacgaaacagtcaacggaattaagggcactggttttggtattatcgatgagttaggtattcaagccgaaaaagaaaataagattatgaatggattatatgaagttgagagtggagctgaccaaggttatgagaaagccgaaaagatgttgtgccgccaaaagaggagaactgccattttatggatagtcatcgtaattattcttgtaattttattagttgtcttcttatatttcgtcttcaaatgaagcacaaaccaataaaaacaatatcttttatgaccattttctttctatgtatttattaaaatttattcttttgatttcttttagaagaaatttttttccttgattttcaatgcttatatggtcacatgtctgtcacattttgggatgtttttgcttgggttttcatttttttgttctttaatcatatttattacatgtatattattacgctggatcctaatcgaaataatcaaaaaaacaatgaacaaaatatttagtaatgaaagcaaagtaattccaagcattaactttttctcattttgtgaaatcagtggttcttctccatcaaaaaaacttgtggtagaagacattgatatttcttttcatttctttaaaacaaatacgtctaataaagtacacattgttgatattgaaattactaaatttcattttgctcaaatttccaaaaatgaagaaaacaaagagaagcaacacaaggccacaccttttggtaggtggattcttgaacatttattttacatattttttgtactttttattaaatcagctaaaatcaccatcaaagacatcgaatttcaggttaaaaattccacaacatctattcattccattatttttgactggataattattcccgaaatcaaaacactcaaagctgatttacaaatcactgaactttatctttccaaaggcccattatctattcgtattccggaaatccaagttaagaccaccagttccatgaattctcttaagtatcttcttggcagtcaactttcagtttttgttgatacaatttctaaagttaatcttaattatgatgacggccttataactactgaacaatttacgatgtcatgtgttgtcccacaagaacaagaagctgtttctaatgttcaaatttctccattaaaaatacatttaaccaaattagacttacacactaagcaaataaacttcgaaataaatgacatacaatataccaatggaaggatttccaccggcgtaatcaattccacacgaaattcgtcgcatttattttcagttaaatcattagaattagaaaacaaacatttgatattagaagatttcgaattaacagtttgttcgacattactaattgacaaatcattattaacgcgatttttaaatcactcaaagagttcaccaaagaaaacatcaacaacaacaacaacaaaacaaagtgataattcatttatagttacatcgaaacaaatctcgaagattaaatattgtttacatgatatgcatcaatatgaattcttatttaaatcattccaattaaagaacaaaatcatttcgtcgaaacatttaatagtgaatcaaatatcgccaccagttatacatcgattctttgaaggctcacgagttagaattaattttgcaaagccaaatttcggaatcatttgtacaaattgcgaaatgtttttaactaattcattcccacaacaatcgatgatcttcgaattctttggaatgaattcatttatgagtaaacaaagaagaggtccaccattagcaaatcgtaaagaacttcctccgacatcgaaaatattttcacttgaatcagaagcatttaaagtatcattaaaagagaatgaattatgtcaatcaatatcaaaagcattcgaagcgaaaagatctgcaatggaaggattaatgatgagacaaaatagagcaatacaaataatatctgcgaagaaaagaattaaatttaatcaaaacattttcgagcagaaaagcaacgaattattatttaatttatataaagaatgttttaatcaaatgccgaaaaataatgaaaaagaagatttaatagcgattaatactaagaactttaagtttataatggatggacctgcgataaagaactttaatgaaggattaaacaaaatcaaagaaattttacccgaagttaatgaagaagaaattggtaaaatttcaggtggaaaaatcacattaaattcttctttattcgaaatatcaatgggtaaagttactaagttattaactttcgtagactttaataacactggctatttcttaaaaggaggtcctattggtaaattacgcgaagactttaaacatgtcagaatcacttgtgataacggcaaaacggtatttaacgttccctctttagcgacaaagtcggtttcttttatcgagcttcattcaaattcaaaagagatcgtattcaaaaagtcgcccgcttttaaggaggccgatcaaaaccgtaaaattggaatgaagagatttcaacttaagaaatatgtattccaaagattacgtctatttgataattatcgaattaattataggttcaaatttgatttacatgctaataatttcgaagttggatatttaacaaatgagaatgtatatactaattttccaccattaaaattccaattaattaatttaaatactatatataatgggaaagattttaacatcacaagtgacatgataaacattaagattttacataatcttgactacaaattcattggaagtttaccatatccaaacatttatatgaacattaaatcatttaatccaaaccaaactaaacctcggcctgtttttataaaatataactcatatagaatgccagatccgacgtatgatccatattatgaatatagaacgcatacatactcaatacaatttaatgttacatttcccgaagcaaataattatgcaattttcaatctcgattatttgaatgatttacttaacacattttcaaagaagccgataatgaacggttatgtaaaccccgttcaattctttgttaataagaatttgaatcctaaattatatggaatagaagcaaatattacatttccacattttaatatcttacttaaccaagggtcatttttagtcagaactaaaggggaacctattaactttcgattaacatctaaaaatcaattaaaattatcagcgaaatcatcgaaattcaaaatattaacaacatttaatgaacaagcattattaaaattaaaacttataaatcttaaattcgatttaaatgaaggttatatcatagttatagtttcagatttaatttccgaaattcattcacgaatatttaaatgtattaataacattaacattaaattacctgaaacaaatacaccaaaagtaacaaaagaaacatatttatcaagtcaaatcaacaatgaaattgatttacaaatacaattctataagaattcatttgcttttgcgatcgagacaatgatattacggatttgtttcgatgatgaaaatcgaatcattcaatcaaattcacgtacagttagttaccaacaaaaacttgatgacaacaacaacaaattacattcagtaatgatatcatcgattaacttcattacatcgaatagtgttccattattttcattagagttatttgaatatcaatttgctaaagcaagtaattatcaaatccaaataattaacaacaaaattatatcaataaatccgacggaagaagacttttgtatattcattccgacaataaaacattattacttcaaattccaagagaacaaaaaactcaaaataccaaacaaaatgaaaaacttaataaaaacattaaacatcaaattagaaaaaattaatttgcgattattaatggaagataaaacagtaattgcatcattaaacgcaaataaaataataatcgacttaatccaaaaacaagataaaagtgaaacaatgtcaatcatcattaatcaaataattgctcgagatgaacaatcatctgatgtcttctcaatgatctttgagacgcaaaaagagaagttcttaacagtaaacttaaacaaagcttattccataatgaaatgtcccgtcttccaaaaaatagatataaacgtaacgccttttgtcataagaattaatatgccgttctttaaacgattaataaaatatttcccttcgtcagacgaattaagaatgttggacatattggacgaagaagatgaaatggatgaacaaaacgatttggaagacgaaatgattaacgcattgaacgaaactgcagcggatatacagacgcagaataaccaaaacatattcttctgccagaatttccagtttcaccctttcagggctggcatttgcgtaagaagaaaggaccagggattgctgtcagagttcttggacagaggattctcgtatccgggattccattactatgacttgttcggaacaaaggaaagattgacaagaatagtgaagaagaatttgaaatgggcaatagtgaagtctttgtcttctttgttgttcaagaagaaaaaaagaacccagaaaattacaaataataatgcaacaatggatgagaaaaaacaataaaattttgttgaaattaaatcttaaatttgtcatgaaatgtgatttgaatttttgacgcgaacagacttcgtcaattttgactcgatgagcgatgaattgatgtggtactatagtaatagttcgataggaaagtggcaaaataaatgttcataaattcgataaaaatttacaaatactccaatatcttaaaaaaattatattcgacttaaacaatgaaaatatcgataaatctgttgaattaactctgaattattttgattaagaattttcatattcatttaattttattatttgtacaattttcattcaatcaaatttattgatgaattttttaataattacgaagaactttcaaagaatgattgggaacttcataagaaatatattgaagaaggacataatccaaatgaaattgcaaaaataattcgaaatgatgaaatagaaaaacttcaagaaatatcatcacaaagcgattttgattttaatcaaacaattgaaccatcagtttatgaaagatgttcatttattaataaaaacaatgtttcattaattgattatgcagcatttttttctgctatcaaatgttttaaatatttacttatgaatggtgcaaatgtagaaaacacaggcaaatatgcaattgcaggtggaaacattgaaaatgttcatttatgtgaacaaaatcattcatcatttaaagatgcatataaagctgcaattgaatttcatcgaaatgatatttttaaatatatttatgataataaaattgaagaaattagtaatttagaaaaattaggaagtgagtgcgttttgcataataattatgaaattctttcatttctgaaaaagtaggaatgaaagttaatgaattattaattattgagtcattagaagtaggtaatttctatattttacaatattttcatgaaaaaaatccgatttcaatacattttttgaaaatttctactgtttctgaaaataaagaactttttgattatttaattgacaattcatatattgaagataaaattaccaaactagtttttaatttttttttttaatattccaatataatatttttaatttataatatatatttaatgcagcttttattttttcatttcagagaagtagtttggaattagttgaattacttattgagaataagggagtagatattaatactaatatatatacttacatgctatatattatttaatatttacttaaatttcttgaaacaccacttatgaaagcatctgaaaatggtcatatagaaatcgttaaattacttcttgaacatgaaggaattgatgttaatgcgaaaaataatattttcattaatatattaggacttcataataatatttggaaattctttaaatttcttgaaacagcacttctggaagcatttaaatattgtcatatagaaatcgttaaattacttcttaaacaagaaggaattgatgttaaagctaaagacatttttaattttcatttaaaatctattttcaaaattttatatttcaaaataatatttggaaattatttaaattatttaaaacagcacttaagtatgcatataaaaaaaattatccagaaattgtacaactccttaaaaagaaataaatttttatcataaccatatgaaacataaataaacaaatttgttttaaatctattctttttaaaatatataattattcacctcaaatattaaagaattaataaacgataaatttttaataccatcaaaacgaataatattttattttttacttatttctctatcaaaggattatcatttacataattcttattatcctttgaatattttttaacataaaacacaatgaaaacgacaatcaaaatcacaacaattggtatacaaacacccaaaacaattgccaaagtattatcttttttcggttctggttcaatatcattacactcaaccaaaacattcaacgaaacattaaaagttccgaatttatcacatttataatcggaatttaccattacaaaactcaatttcacatcaacgaaagcgttttctttaataattggctcattttcgccataaaaataaaaacatttaagccgaatacattgataaaatgagaaatttccaatagtttttaagtttttaccgattttaattgatttcaaattaaaacatttataaaatgtatattcattaattgcattaacataatcagtaaatataaaactcattaaattaatacattgataaaacgaatgtttcccaatttctcttaagttaacactaaaattacttacatttaacatcaaacaatcaacaaatgaatattcgccaattgttgtcaatgaatttggaaatgtaatttcttttaagaagtaacattcataaaatgcataatttccaataacttttaagttattattatttatattaatataatttatgttcctacatttataaaacgaattatctccaattacagtaatggaatttggtaaattatatgtatcttctttctcgattggataacttattaactttgtcatttcgttattgtaaagaattccatcatcattataattagtgaaatatttgttttctttatcgacttttatgtttttaagttttttacaattgaaaatcgaattagatgaaatttctttaacattttctccaattgttaatgattccaaaacttcgcaattatgaaacgcaaatacttcaattatctcaacggaagttggtatattaaatgtttgtaatgtattaccttctgagaaataaataatttttgttaaattcttatcgtatataattccgtcatcattataattactgtaatatttgttgtctttcgatattgtaattgtttgtagtcttgtacatgtttcaaatgcattttgtccgatctctttaacattacttcctatatgaaatgttttgatataatgacatgcaaaaaatgccttttcgccaattgtgacaacagaattaggaatttcgatggttaataaaagagaacatttatataagaaataacttccaattgtttgaacattctttccaatgctaatcgtctctaagtaataacagtaactaaatgaagaatcgccaattgtaatgactgagtcgggaattattatatttttgagagatcgacaattattaaaagctgaatttccaatggttgtgaccgaatccccaacgtttgttagctctaaaaagaaacaatcagcaaatgcagaatctccaattgagatgaccgaatctggaattgtacaattttgaaggctgttcccaccagcaaacgctttggctccaatggttttggtgttgtttccgatgatgactgattctaattcattacaaaagaaaaatgcatgatctccaattgttgtgactgaatttggaattgtcagatttttcaaagaagaacattcataaaatgatgaatttcctataattgttacactatttcctatgttaattgatattatttcaaaacaataatgaaacgcagaagttccaatttcttgaactgggcttaaaatatcaacaaataacagcttgtcccaattgtaaaaagatcgatttggaattattgttatgttaccaccaattataacacgcgacgttacttctttaaattctgttgtaaattcacttgtttcattaatttcaagtgttccatctgaaaaatattcaactgttattgcaaagagaagagcaaaaatagatagaacgttcataaatttatttgatttgagatcattttagttgataattgataagtttacaaaaaatcgattgacgtgaactgatgtcatcggctttttggcgatttttccaaattgaatggttttaaaatattttgaatgtacaaaccgtcgttataaaatgaatttttttgggtgaaggagtcatcggaatttattccaaaattgtgagtaccttatgtttattttcgaagggttcagcagaaaaggccgaaggcccctatacacattggaaggaggttatttctgcaacgacaaaatcagggcaccccacatcctggcggttttttgaatgctaactcaaaacgatcaatttcaacacaatttagctaactgttggcagatgacaacgataagcattcaatttgggaaatcgttcacatgttttataaaaccgctcgaccacataaaagaggtttaaaattggtgaggttaattaccgtttaattaattcagcttaaggccttgggtatacagctctaactggtgcttgttgatattgaggaactgaattgggttgtgggacaacttgaacatattgtggtggtgtaggaacaacttgaacatattgacgtggagcttgttgttgaactggttgttgaacaggtgggatatattgtggaagagatggggtttgaacaacataatatactggttgtggttgtggaacttgttggtattgtggttgtagttgtggaacttgttgatattgtggttgtgcgcgtggaacttgttggtactgtggttgagactgtggttgctgttgtggaacttgttgatattgtggttgtggagttctttgagatcttctttgtgagcgaccatgcctcctgcgtgttctctcaggtctttcattgttgtaaaccattgggatattttcattttcgttgttacgagaactagagcaagctgaaaatatgcaataaataattcctgtgagaatagcgataaaaccaaggtagaaagcaaccattacaatgctaggaagaatgcttgatgctttaccataacatggagtcttcttattatcattataatttcttgtccagtaaggttttgttgtggaagttggtttcttagagacggtaggcttgtaagtagatgagggcttcctcttaccatatgttcgatgagggtaatgagcgcaccctaaagaaaagagtaaaaaaagcatttgtttgaatgtcaaataaccgttgaattaaaatgaccaaattcaaccgccggagtttttgaatgttttacatgtagaattatggttaatttatcgtcagatgttaagtaaactattcaaattcactatatctattggagaattatgtctcatcaaaattttgtaatgatattttcttattaaagcattcttcacatgatttatcagtatagtaatgacataatatcatatttgattatttcttttgaagtttaatatcaaataacttatcatttcaataatgttaaaaattgattttgtttaaaaaaattatatattctttaatatttaaatttacttaaacactaaagatttagtgacttcattttttgatttttttgaaaaataatccttcataaaatttaacaaaaccataacaaaaaatgagaaattcatttcgcgattttattatcgaaatttcacgacaaccaaagcttgaggagagaaaggaaatgatgggacaagaactgtctcgaatcagaaatcgattaaaaatgaaagaaaaatcacgacacttaaggataattgcaaaattaatttttttaaatcatgcaggttatgacgtttctttctctcttgtagaaatcgcaaatgttatggcaagcactagattttcgacaaaatttattgggtacattgctgcaggtattttatttgatcccaaaagtgaaacatatcttctaataaatcaaacagttttaaatgacttaaaattttatgaagaaagagttcaatgtttggctttatcactgatagcaaattacaaaggaagtgatttaatagcaaatgcattttcatctattgaaaatattattatgaaatcaagaagttttagagttttaaaatgtgcaggtgctgcattaatttcatgtataagagaaaatcctgattatatagaatcggtaaaaaaatgtattccttctcttcttgggaatcaatctcatgccgtgaaaattgttggtttaaaaattgtaagtgaaatacttaaaaatattgaaaataaaacaaggtttcaatcaatgataagtacatgcattgaacttattagaactttaagaaatatatatccaactagagcacatggatttgttggagaaaatgatccatttgcacaaatatttgctataaaaactcttggaatgattggaaaaccatctgatgaaatagattctttattacaaagtataattactactttagatccatcaacaaatatagggaaatcaattcttttagaagcagttgaaacaattgttaaaacatgcaagaatcaatcattgaaaactcttgcaattaatcaaatcggaagattattaaatcctaataatccaggaacatgttattcaattctttctgcattaacaagaattctttattcagataaaaacatgattaatagaggaagtgctgataatctttcaactcaaagatatagggatcaaatagttcaatgcttagaacaagatgatgtatcaattaaaagaagagctcttgtggttattacagcaattgttaatgaacaaaatgtaaagaaacttgttcctgatataatggagcacatgaaaagtgttgataaagattttctcgcagatattgttccaaagttattcacatgcattgagagatttgcaccttctcctcaatggaaaatagatattttgattagattggtcaaagaaaatccttcatatataaacaaagagatattaaattctttctgtagttttgtttcaaatagtaatgaaatatgtagttttgctttaaatagaatagaagaagaactcccaaataataaaaacaatcagcctttcattcaaatggcttctttttgtattggtgaatatggtgaaaaagctgattattatcttaacatatttcaaagtataattttttcacctgggatttctggaacaacaatttgttatcttttatcatcaattgcaaaaattgccattaaatttgatttaattaataaaattattaacgttattggaaaattttgtggtgatcatcgtatagaagttcaacaaagagcaggagaaataattagaattttaaaatcaggaaattcattaaatatttattgtccaatgaaacaaattggaacaagttcaccttctagaattaggtctaagtcatatacacaaaacacaaatgataatgctaaactcgttgattttgaaagagagaatgatcaaattagaaaaagaaatattacacagcctgtaacatatcaaagtaaaactgacatagatatcaatattactccacctcgtggatctattgaagtcattcaaacatcagattttatattattttttgaaatccagaaaaatgaaaatgataatagacaaattgctattagaacatctttctttagtaaatccaagatttcattaccagaatttagtgcaaaatatgctgttccaaatgggtggaatttaaaagcacaagctccatcaagtaatatacttctgccttatggagaatctccaattcagcaagttcttcttttaatgaatcaaggcgttgaaaatttaacaatgaaagtttggatttcttttatgtttcatggacaaacaatcacttctatttatgatataaataaaattattgattaaaaacatcaaaatattttctgtattatatttgtttccttgagaaactttaacattttagtctaaatcttcttgattttaatataatatttaataaaaaaatttttttttaaacatttattattatgcgatcactctcaaaacaaatatttattttttaacaaaaatttactttaaataattaatataaacactaatgagaaaactattaacactgcaaaaattttcagcatcaaacacttgtttccttttatcttttcataatactttacaagctggttctggccttcccggatgttactgagcgcttcttctgtgttttggtcgattcgaaacacttcataatcttgtgatgcgataatctcagataacctcacaaacatctgagatatctcatttatcgcttgctcaacattcctgaccatatcataacgctctcgttgctgtttctccatcattgtgctttgcataggaatttcaacttcatcattatcaacagaatatgtagtggaatatgattttggtgatgtagaaactccaaagttttgtcttctttgtttgattttctggatagcttcgcttctttcttgaatagctgctttaaaatcttcagtgattgtggcaagaacacgccgaagactttgtgctatgttataggcatattgtggctgtggttttatttgttctaactcttgaattttttgattaattgttcgaatgtcctcattcaaattaaaaattaattcctgtatttgcgtttcatcttggttaagtacgttaccatttttcattaaagaacgaagtgtttctattgaatcagttgcatataaaagtcgagatttaatatcacgagcagaaattgaaaatttagatggcttactagatgggggtgaacggacatcgtttctaggtgggatttgctttaaataactaaagaattcagatgtcctgttcattaatattaattgataatgtttgttcgaattcttttacgattaaaattaccagaaaaatttaaacggccgtttcctcttaattatgatgagagcaaatatacatgtcactttaaaaacactcaatttttacaaaattttattttctctcaattacctggacataaaacaactttttgatgggcgatctaccaccgataaacacaaaaagtaagtttcgccttcaacacaaatacctttggtactaacagaaaaaaaagggtgaaagaaaagattattttattcacactacatagtttgaaaaaaaaatgtattaacaacactgcaaagtgaatcttcttgaagagatcaattcaattgatcggaaataaaagttttggacctgtttcatcagcacgtgagtaaaaagatgcatctttatatacatctgctattattctttttcttttttcgatccaggccttatgatcttcttgaaacttttttctttcatttaagattgattctatgctagtttgtatttctgatatttctgaaaatagtctgtcttccttttttgttggatgatcttgtgctattgatttgattttattatacttattgttaagttcttcatcggattttgataatgtctgtgaggaaggtcgttgagcttgtaaaaaagatggaaaacttatttgttcacgtgatattttttttgttcgtgttaaaccaatatgctttcttgttgggtgttcattgatcggagtaaagggcgtctgctggaggaaggtatcaaatgaataatttctaaatttgcttagtttgatgccgtgggagatctcttttttgtcgtgcatttctaaaatttaaccagaaacaaaaaccgatttttatgaactcaaaaattggtctttcaattttgtttgtgttatattgaattgaacaaaaataattgagtatggttcttttaaaaagtaacctctcaaaatgcttgtgatcaccttattacaggaactgacttcatgaagaaactacttttttttgataaaattcttcacaatacaatttaatgcaagacgtttttaaaaaaatttcccttgttacataatttgataatcataatttttgacctcaagagaagaaaaacaaaaaacagattgaatagttgttttccaacattttgagagactttaaactgtaatcataaaacaaacattttcgtttctagcaaatttgttccattatgatgagcaccttatgtgcaatttaggtgagtttgacagaaggctttcagattataattattttcgcacatggaatatgctcattttgcaataataaaatcggagctccaatccctgacaaattttgacagaaataaagcttttatggaaaaaacgttcatagtgaaatttgtgtgatttacaaattcaaagctttatttttattaaaagaaagctttactgctttttctcacaaacgatgaattaaatatcaaatattaatatcccatcaactctttcgaaaagcattaattccttaaaatgacgataatacgttcacaagttatgaatattcgatgattgttttgaaaaaattaaatctaaaatacttaaaaaattatttatgcataaatattttattcggtgtgaagaataccatttgttagcccaaattattttttattataaaatggaacttttctccattttaacgtcctccttttatcacaccacattttgaatttattttgatcatgtcaaatataaagttcacaaaagtttgaatttgtttttataacatcaaaccagcgcatcaaacgaaagtgccattttctttatgttgccgaaaacaatcgaagacctaaggaagacagtcgcgacagcaaggaacaaaatgccgtttaaaaggaaaatggaaattttattagaatttgtaaaaaatcataattatgattttcaacaaattggtattcggtgttatcaagaaccagatataatcttagttaattcatttatgttaggatctttcttacggatcaagccaaattccattaacaaaaatttaactgcaataggatatcaagtctcaaaagaagaaacatcagcatttcaaaacaacaaagaaattcaactttcagataagaggcggtggaatattcgtcataagatatgtgctgataattatcaaccatataatatcatcaaagaaatcaatgaaacaacaatattagccaaaagcataccaatttcatctttaaacataaatatatattcattaactctcaaacaaacgaatgaatggaagaagattttctttaataaagtccaaactgaatgggaaacaaattttaattcatctaaaggaattacatatgatgaagttgtcactaatatattcaaaacggatgaagatattacgaatgagaccaaaaatatcttcaaattaatgagcggcgatgacaaaagtgaattctttggcattgataactattatcggttttgttcgtactttggatttattgaaaattcggcacaaaacattcaagaaatcaattccatcaacttccgattaagttatggcgaaagtccatcaaaagcattattgaagactatggatgttggggattacatagtttgtttgtcattagttcccggcgaatttattgttctgatcaaaaatcaatatgaaatcggaacatatttaatgagttataatgcgctgacgaacaaatattcattcgatgatttgtttattggtaattttatgttcgtgtttgataacgttttaaagaggtttttaaacgtagaaaaagaaaatttttttcagattaattcatatttcatcgatgaagaggatactttcgtgctcgagaataacaaaaacgaaacatatgaattcgaagcatccgaattcgaaagcattttttaggtgtgttaacatttgattattggcaacgtgctgaaacattcagtggtccaaaggaacattgaagaagcagataataataatatgttcaccgatttgtgtgaaaagtcgaatatgaattaaacactttcgtaaattttgtttttgtttttgttgcagataaacgaatttgataatttgcgtcgtttcggatgtcgtcggcggatgagttacatttcgcggattgtgtacagtttataattataaattgcagtgcttcatgaagatagacagaacaagctcacagcgaggaatgagtgctacaattcacagagaggaatgagtgctacaattcacagagaggaatgagtgctacaattcacagagaggaatgagtgctacaattcacagagaggaatgagtgctacaattcacagagaggaatgagtgctacaattcacagagaggaatgagtgctacaattcacagagaggaatgagtgctacaattcacagagaggaatgagtgctacaattcacagagaggaatgagtgctacaattcacagagaggaatgtgtgctacaattcacagcgagattaagcttggcgatgttgaaacaaatttatgagatgataaactgattatctatatagataaaaaacacaagaaaaagctaagtaatacaatttaggttggtgtttttatcaagcttttggagattttttgtattttatttatccaatgcagatacatgatttttatgttctctgaaacagttataaaatgataatttctttgttctttctaatgatatattaatgtaatggaataaatcttctttgcgttcacttctgctatatataattctttctcatagatgtatatttgtaattgcagcattgtagaaggaactatagaaacgtttaaaaagtgatttttgatgagattaattagttgaaaaaaaaattaaaaattaatatcacctttagaatgatgacaaagaattacaatatggacagtgatgaagcttggcttgccttgactccaggcaatcatcacagaggacattatggccacaaggtgcgattgcaacagtcgcatcatttttcagacatatgcaacatttccctgttacatcactattttccactctgcaccgtttcccaactgttatgttgtatatttgctggttggcgataagttgttgctgggcaaagttgaaacacatttcatcttcatcatttaataatctgaaattaagaatatgttttgaaacaatagcaaacccgggtttggattggacacttttaagatttggtgtaatttcaacatcaaaacttgaatattcagggatcggaattgaaaactcagtacgatctaaaactggtattcgaaaagaatttatatgcccatttgcaacaacaacaattttgcaaggagcttcagttttgattccgaagcaaaggaaatcatttccattaaagtttttgatatatggatctggactagaaacagaaattactgttttaagttgtgtgcttctttgtggtggagggttagtatttttattgttgtatttcctcattctttcaacttgaagttgttgaattgctgctgctatttcattagcatccatatcatcaaagttcccattgtctccaaagtaagaagagttacttcgaatcttgtcatctgactcttgttcattaaatgattgagaatttcccattttaacaaaaccgtcaaattggggcgctccatatcaacgatgttaacataaaagtgctttttgtaaatttttcaaaaagtttttactatgcctttttttatcaagaactcaagaaaataaaaccaaaagccatttaataataaaaagaatatttatatcattgttttaaataactttgttatatttattattattattgtattgaaaataaatactgaattatagtaatgctattgggaattaccagaatggaattaattttgattgatttaataaattttttgatttacaattacctttataagaggctatatgaaaaaacacagagaaatgaaaccatgatgaatctgatgataaactcaagacaaatgtatatttatttttttttttagtttgattttaaataatcatataagatatattgggtggtgtttctgaagtgaaggaatttatgaagaaaaaaataaatgatattatatttttgcgagactgatatgaagatattacatttacaattgtgttgtgatcatgaatttgaattaattgattaatttcgagatatttgtaatttattctcaaacttactgaattttaatttaaaataataaaataataataataaagttgattaggccatattttatttgttggttataattttcctccaagatatttatgtttaattaaattcagttaccgatcaaaatcattcaaaaagccatcattttctcctgacgatagtatgtaaagcaagcaaaagtgaacgtctggacatttcccactttttctgccaaaaacctcctcgatagagattttagtgaataatttttggagaatcgcttaataacacgcgactttttctgaggaaatttgaatgctttattcccacttttgggtacatccatgagaaaagagaaaaataacaccccactttttgtgtgatttatcatgtttcatccaaatcagtgcaatggagactcctcctgagctcatagaagcatttactcgtcttgacaatgcattctttgaagatgtacatgctcttgttcaacgggtgcgcgagatttctgatcaatataagtgccgatatgttcctagatcaacaggtgaatcaagatcaatgcaacttttctgctgtagacagtatcgaacaatctataactgcaatgcatgccttaggattctttacaaccccgaaacacaattagcacaattcgattcttgcgatttaaaccacacacatgaaatttctgcatcatacaacggaaaagaaagaaatcaactaagcgaaacacaaaaaacgaaaatcagagattcaacattacaaggattatcggcttataacattcgcatcaaacaaggattggtttgttcgaaagatgtattatacaatacagaaagaaaaatcttaaaaaacattcgagaccatgaaatggatgaattgcttgatcaaatgaaaaatggaaataattggtcgaacaaaaatagatgaaaataagcgttttaatggatgttatgtatttcacgaacctattatgtctgaaaaatatgctaatgatctgtgcattattgacgatacaagttgtacaaattactatcacctcccttatttattaatgattagtgaagatcaaaatggtcgaaaccaagtattatcttttgcaataatatgctcacgaacaaaaaatgaatttataaattattttgtagaaatcaaacaaaaaataggtgatatcaggctctttatctgcgatcgaaacaaaacacaggtcaaagcactgaaatttgtctttccattttgcaaaattatattttgcagtgttcacatttctcgtaatcttcgacaaaaggcagggcaagaaatgtgtgatttatttcataagctacaaatccaagaaatttctgaagaagaatttatcaatgcatgtaataattatgtaaatgaacatccaaaaacaaaaggatcgcgtttgttacaaaacttattagaggatcaggataagtggctaccaagtataatttcaaaatatatacattgcgataatacaacatcaaatcgagttgaaggtttttttggaagtctcaagaatttactagaacatatgattgtaacattaggatatcttgtatatgcaatttatttaagaggtgaaaaatatagaatattatctaaaagtgataaaccaacaattatcttacaagaattaatgagcaaagaagattcgaaaaaactcggtacatttgcttcagcaatgatattctctgaatatatggacctcaaactaaatggtgtattgtctattccatactctgagacctgctgcaaaaatcatacattatacaatctcccttgtaaacaccttattctaatgagaattaaagaagataagaacccactcttaacaatcaatgacataccttgtagattgataatcactaacgaaaataaaacagataatcccaataccattgaaagatatttacggccaaaaaacaaagaaaacaattggagttacagtaattgcattgataaatttgaacgttttttctccctcgcgaatcgatcttctgaaattagaaatattctagacaaagccttaaatgatttatgctcgcttgaacatgaaacaggagaagatggagatattcttccaccagaacacatacagatttctggagcgccttcaagatatccaagaaacaatgtggataaagcaaacgctccaaaagtgaagaagaaatatcgttgcagtatatgtggaggtgatactcatactgcacctagatgtccaaaaaatgttttagctacttaataaaaacttaatatattatactcataatatcaaaaatgtgaatatacagtttaacagttcatgagaaaagaacatcataaatcatgtgagaataagcatattcgagaatccttcgtaaactgttggaattccaaattctcctttttaaaaagtcgccgttgcgttcacaaatgaatgtttcaccatgttttcatttgaaaatgctacgagatgacttgctttaatgccaaaataaatcacacaaaaagtggcgtgttatttttccttttctcatggatgtacccaaaagtgggaataaagcattcaaatttcctcagaaaaagtcgcgtgttattaagcgattgcccataattttttgtgaggaaatttactgtaaatgttacattaacattaatttacacatgtaaagtattaagaaattctatgaggtacgtcaaacccaaacagaaacataccagcgaattgacatcggtgttatttttcatggtgtcatttttaatttttaatgacttaccacattagttcatttttatttatttatgtccaaaataccatatcgaacaggtatgcctaaatttcatattcgagctaaatatatatcatacgatgacgaaaaaagattttccaaaggttaatcaaacctgatcaaaatcaacctttgaatgctattcataagcaaagctttattacaccattaaagatccaagatcctaaaccttcgattacagaaaagccaatagatccttctatatgtgatgattatagagatcctttttgtgctctggaaatatttccagaagactcctttcctgctatagagcaaggctttgatgactttataaataaaaatgaaatatttctaaccatcaaaaagtgttatcggttaaaatcttagagtgccctgttgtatgaatcgttctaaaagttgggtgggggaggtttttgtattagctcatataataaattcaataagaccatttcaaaaagtgagaaaggtgaagtcgtacgtatttcatcttagcacaaagtcattggttggataagttaattttgtaatgaaatatttaaatttttttgagaaaggtgcaacacacgatgtcgtttgaaaggtaaaatgaattcgcgaataaataattacttacctttagcaagtgaagcttcgattcgattcgattaactccagcatattttaaacgtgcaaatatttatggcgggtgatcatttgatttgaaatgattttgatcggtttctaatacaaatttctgttaaagtttgcaagaaaatcaaattttttttttgctttttgatttcacaatagtttttattcgcaggttttgtttttttctaaattacttaatgcatattccttccactttagcagatttttgaagatattcaatgcaaaaacacattaaaacaatgaaaagaatattatgattccaaaaaaaaaaatgtcaactttttattgaactgcaagtccataaatggatacgatgcagtgcattgattcattttcccaacgaactgttaccattccatcactattgctatcccaatagcatgatgaagaaacatgaagaccaccaccagctttttgcaaaataaggcattgagagacaaatttgtaagattggaaacgctcgcaaagagcacgaagtgtattttccaatatatcactcgaccacttgtttacagcagagtgatcgtaaacttgattcttaaggcattcctggatagcttgttctgtaattgtacgaactgcgtcgttttcaaattttggttgctgcataggaaatagcactttttatcaggtcaaagtatgttcccgatgtatggcaataaaattatagaaaacgctgtcgaccgataaaattataaacgtccaaagcccatcaaaaatgccataaccgccaaatcacttcacatccaatacaaccgttttttcaataacaaacaaatttcgaataatttcattagctcaaaagtatttaattgtgtttaaattggaagctaattaaaaaaatttattgaaactagcttcattaattcaaaccggttggcttgaaatcattccagaacaagaattaaactcgttcggatctaagggaaaatcaagaaagaaagggctctgactcattattgcggatttggaccttttgacataattttgttcttgtaacatatatttcctgaaatatgaataacatctttgaatgtctttgttttcaacgtgttctcgttgatgcattggtacgtaatcaccccgacataaatctggatgattttcccaaaatgttttatatccgccttggagtaaaaatatgtatgggtatgtcttattggggtaaacctgaagattctgattacggtcatgctcaaggaatattgaaaaaacttttggtcctctttcttgtgaatattcgcaatgtattataactgctgtttcatttgctacgtccttaaaagaattgtaaaggctgatgagttcagacctatttcttatatgtcttgcacctagaatatgccctccttcatattcataaaaaaatctaacatctaaaattaagtaacgcttgaaagctctgtgtaagcttgtgtccttcattatctcagcaagctggtcatgggtcataatacgctcagcatcattaatagaaccataccttgggcagtacatgtcatggatagagcaatcattttcgtccatgaattcatcgggagtaggaatcccatgaatccagtccttattcaatgaattgcttgtcgagaccatgttagcttttgctaaacgcacagatttatttcaattttcgtatgaattttggctattttacttcgatctttgccagacctcagttcaaattgttgatagaacgtaaactataaagtatttaaatgccgatatgctcaaacaaaagtcaataaagccaaaagctgaatcactttttcaatataaatactgcttgcgaaaggccaaaattcaattgaaaattatgggcccttttatggtgccttgttatcttttgccaaaagcaccaaaaacattttcaaacactttaacgaaggaaaataaaacacaaatagaaggacgttcctcttacatattactacactaaatgtttgaaaattaaagaataatatgaattatgattttaaaattttgtagcgttaaacaaattataacaaaatactgtttgactgcttaaatgattctcagagttatgggctattatcattatctctgtgatttataaggattttttgtgcaagaaaaattgtgggtgtacgtttattttattaaaatggcacaaacaaaaactgatgtgaaagcaagggaagaactttcagaggaacaccgccaagaaatacgtgaggcatttgatcttttcgacacagatggaagtggatcaattgatgctaaagaattaaaagttgcaatgaaagctcttggctttgatccaacaaaagaagaaatccgtcgtatgatcaatgatgttgatactgaaaaaactggatcaattagctttgcacaatttttacaaatgatgacaaagaaaatgcaagaaagaaatccagaagatgaaattcggaaagcattcaggctttttgatgatgacaacactgggaaaattacattcaagaatttaaagcgtgttagtattgaacttggtgaaaatcttaccgatgaagaactcagagaaatgatacaagaagcagaccgcgatggtgacggtgaagtttcatatgaagaatttgttcatattatgaagaaaacatcgctcttttaaaataaaccataaacataccatttcccttaattctttccagattattcatggctatgtcttaaatcacgtaaaagtatttatcattcagttttgcacaacttttttgttgttatttttaaacgttcacatacccacaaagaaacagtttatgtcactttttaagtggtttaaatgtctggtgctccacctgggacagacaacccacaaatctcacttgtagaagaagatgagcatcaagtatggagccaaaatattgatttaggttctggccctaaacttccaccagttgattttaaagatctttttactcataaaacttctcaatatttcaatattaagcgccttctgactagtaatccaagttctagcaaaaataaaattgttacaacacgacgaccaaaaattccaaaatttaatacaaaatttcaatgtccacttccacaagtattagtacaacaaggtggcgattctgaaccatggaatctacggtgtttttgtaatattcgaaatgaacatggttttatgattcaatgtgaaaaatgtttaaattggcaacatgcagcatgtgttaacatcaaccaaaacaccatgcctaacaaatacatctgtcctatttgttctaacaaacacattcgatgttcgtgtgaagataatcttaattaccgttatcctcttattcaatgttccaaatgtggttattgggttcataagaaatgtgaaggtcttgattctggtccatattataccaaaaatcatgtttgttataaatgtggcggaacaccatcacaaccaccagatgttcatttaccatttgcactccccattgataatcctgttgttcatatttcacagaaagttatcaacgaaatgcacccgtcgattttaacggttccctacatcaacatcttaacggtcgacttcttagatcatgacattagtttattccaatttgttgaaaccatatataacaggatgcgttcatttttttatcttacgcatccattaatcatatttaattcgttaaagaaacgtcgtggagatgtttcattttcattctttcgatccgttttttatattttacaatttttatatgggattaaccaagagacttctgtttatctctttgatttattagccaaatatgatatctatcatccgtatgaattaccgacaacactttatacatgtacaatgtcaccatttgattgtagtgatccggcgaaaatcgaacttgaaaaacttaaacatattacagagattctacaagttacattaccatcagatgtgcaagttcgaaatggtaaattatattgtcaatcgccattacaaggcgaacaacttatagcagttgttgaaggatttgttggcaccattgatgaattttgttatgataatggcgttgatcatcgtatatattccatatgcggcacaaacttagtcattgacacaagtaaaaacaatccgcaattcatacataactttcgacgtagtttatgcccaaattgcgttgtgaagttgttcaaatgcgatggagttacatacgttggagtattcgcaggaatatcagatgtaaatggtatatcgaagcggacaagaagagaaaagttttcgatacttccaaacaccgaattattacttccaatcgatttcgcgccggcaacaattgaagagccgcaacaatttatgaattggcgatttaatgaaattgatattcaagagcctgaagtcatgccaaataataacgagaaaaaagaagaaaagtcttcgcctcaaaaacatacaagaccttcgcgagaagaaagagatgaaactgcagctataagacaagtggaaagaaataacaagaaaaagaagaaaaaaatggaaagtgaagtgaaaattaagaaaaaaccgggaaaaccggcgaagccgttaaggggcgtaaagcaacaacaaaataataatgtgttggaatgctctttgttttccatgttacaaagtgaaacaccgagaacagatttgtttgaaatccctaacgaagaatttaaacaagatgatatggaagatgtggaagaatttgatttggaaacaaaagaacctttggatgaaaacgtcgattatagtttcttgaattctttaaacgaggcacagataatcccattcactccaatggagatttgtgacccggtgaaggagatgttgtcgattatagatatgaaatactttaattaatatttgtataaaagtttatgaaataatttattgaattaacggtggcggttttgatcggttttaatggttcaaaaaaatgaacataaaatgtcggtttgctttcagacagttattttgactttgaatggctgtcaaaatgatttgtgttggtattttttgaattgaaattctgaatggtctattgaaaattaaaaaaatcaaaaaaaatgtatttttctcgattatgaattgatcaatgaaaatatatttataattactgatttgactatcaattatatatttaatattattcgatcaaatgttataatttatacagatttcgttattagattgaattaaaaatgttcattgttttgacaaaactgtaaaaaaatggataatacattatttaaaatataaatactgcgataataattcaacaaaatagaaaaaaattctattaaatttttcaaatttataaattatatatattttcatgcactatggatgaaataaaagataaatatgtgtttttcaatatgtttcttgcaagaaaatattaagaactttattttctataatttagacacccccaaatgtcaactcataccaaaaaacccaatgttccatctgaagaagaattaaacctcgcagatttaaaaatagttccagaaacaggtgcaactatacttcatcattgggcgtcaacaaatgatcttgacccattaattattgtattggcaaaagcaggggaaaaagcaatgttaatcactgattacttcgggaacactgttctacattatgcagcatgggcttctgctagagaagttactcaatttgttgtaaatcattttccaaaaactcatttccaaaacataaaaaaaatcacaccagctcatattgcagctcaacgaggtgatgttaatcttcttcgtctttatcaaacatcattaaaaatatttcatgattattctacacaaggatggagtgcgcttcactttgcaatttattatggacaaattgatgcggttcgttttcttttggaaaacaagatcaactccgttgatgatttaattcttggtgcagaatctaatgtttttcttaaccacagaagacttaaatttacttctccatatgatcttgctattatttcaggtcataatgaaattgctgaattactagtacaatatggagcattgccttcattacattcagctgttttatcacaaaacctattagctgttacataccttgttgaatctcatcaatccactgcctccaaaaatttaaatcttactgctggtccaaaaaattatactgcacttcatgtagcagcatctaaaggttattactctatttgtcattacttaattctttctggtttatctacaaatgctcttgattctgatggactttctccacttgaagttgcagtcacatcaaaatccgcaaaaaccgttgaaacgatacaaacgttcgcctctgaagagcaaacaacaaaagctgcttttttagcagcagatttagggaataaccaaataacctttaatcttgttaagcgtgtcacatcgccatcatatagtgatgaagatggtgacaatttattgattcatttaattaagcgaaatatgtttgaagaagcattgttattagtacaatcccaaaaatgtgatattaaacataaggattcacgtggtgcaacagcattacattattcagcagcaagtggacatattttattacttaaagaagtactttcacaatccaaattattaatcaatgaaaaagataataatggaatgataccacttatgtatgcagtattatcaggaaatacagaatcaattaatatccttaaacattcagataatgatcttgcatgtaattgtgggtttacaccattttcattaagttattctattaatcctgaagaaaatgttatgttaataaaacattcgaaacatttattaacaattgatttcaaaattgctaaaaatttatttaaagaacataatttaccaaataaagaaattccatttttgaaaacaaattgtccaatattaaatcttataaatccgaaatttgataaatttattgaatcattacaatatttcgatgatgaaaaagttgaaaatattacagtattacatttagcagctatcggaagttcatcattaattacaaaaataattgaacaaaatcatgatttcttaagttcgaaagattcattaggtcgaacgccattacattattccgcaatttcaaataattataatacagctgaatatttgattactgataatttcgtaataagtcaaaaagataataaaggtaatacagtattacattatatgattaatgattcaatgatttcaattatagagaaaatcataaagaattcaaatgtttcattaatcgatgtaaacgaagaaggtaataatccatttcatttaatctgtaaagaaggatcaatacaaatattaacattatatttaaaaacattagatcccacatataaagatatattaaatgctaaaaataaatatgatagaacaccaataagttatgcaatagaaaataatcatcaaaattgtatatcacaattacattcatatggaatcgagaattctttaataacatatgtaaatgaaaacaatttaactgaaattaaaaaacttattaaaaatggatatataataaattcgagtgataagaatggattaacaccattacattatgcagcaattaaaggtaatacttcgataataaaatatttattaaaacataacgctaatgttaatttacaagatgcacaaggattatatccattacattatgctgctaaatcaaataacattaatgctattaaaacattattaaaagtgccatttaatttggtcgactttaaacctaaagatcaaccatttgctttatcaactgataacgaatgtaaagaatttttatttaacttttggaaaagacaattcttctttaaatgtatattggaaattactgcgaaatcgaaagaatcattaaacatattaaaaggtctttgtactattaaagcgcctttttcatgggattttgtgttaaatgtggttaatcgaatattatttattaatgaaactttaacaaagaaatcattaaatgaattaaactttgcaaattctttacatcatttgttacatatatttaatacaattgattatagtgaatatgtcgattttatacaagcaaaaataattgatataattgaacatactttaaataaagaagtaacacaatatttaatgtcaaataacaataattcaatttcttctgtggtacctttgttaaataatttgcttttagtattttatcctattcattggttaaattattgttcatttttcttaaacgaactctgcaagtattcaaataaagatttggatgatttacgtataattagttcaattaaggtgaacgttaacgaccaattcataaaagccgatcaagtcctcagaaaaataaacgtcctccttgtaaactctatcgtcaacttaaccgaaaccaaaatcattacacaaatattaaatcaaaatactagtagtgtattatatattacaacagttaaagttaaaagtgttcgatcatttacgaaacatatatttcaatcaaactttttgcaagtttataaacgattttatggaaatgattattatttacctcgattaataccatttgcgcgtgaccaaatccttaaattaatattaacaaatgattatattatattaacatcatgtgaaaagagttatgaagcgaacacaatttattttccttactcatgtgtatatgtagtcgaatataaaatgggtaaaagattcgattatcggttcttaacacctgttggcaagttcgaaattaatctcgaaattgaagataaaacaatgtataatattatcacaacaataacactgaaaaatggcggaataaattcgggtaaaagtcaattcagaaaagagaagaatagaatatatcaatgtttggtgaactatgcaatctcgagaaattatttgtcgaccaaaatgatcattgttgaagcgggttgcgaagccgagtgcgaagatatttgtagaaatcatttggaagaaactttgggtcagccaattgcattttactctgtacaaacaagagatataactgcggatgaagatttgattattatttaatatcggattgagtaaaaatatattattatttttcgttgaaatgtttttacacacttgtataatgacgagtaaagtgattgattacatttgttcatttcgacgcagaattgaataatttacgatgaaaaattgatcagtttattgatcgtttttattgtgggcaatgacactttttgtaaaatctttttatgtcacttttaaccggttgcagcacaagacaccctaaaatctacatgttgacactcccaaaagtatatgtaatatatgatgatataaatgattacattcaaaactatagtatatttcaacataaaaaaatttttttcggaccagtttttaaatatcagaatattctaaaaaatttaaattgcgaatttttaagatattgtagcagacttgaaggatcagcaataatcgttgacttgaataataaagaatcaatccaacttagtgattatttaagattttcaattcgcttatttactttagataaatttaatgtcaacaaatttgccgacatccttaagccacgtttaagtgacaaagagattatttattgtgcaatttgtgatgactattcactttatatcgaactagcaaatttatgcgacaacgtaacaaatttaggtatttgcccttccacattcaatccaatttggcgtactgtcaactcaccatattttgtgattaattccaaaaatgttttttcatctgatttatccattaaactatcatgtgaatatgaactattatcacatatgtaccttaacacttcttttatttttacatttcaatttccaattagtaatgaagatcttcaactttatcatcatttctgtgatctttttcttaagaacccacccaacccatatcttactaaacttcaatgttttcttcaaccacttcaacaacaattaacatccactcattacgaatctttcgaatctgataaaatcaaatattcactttacaaaaccgccatatcgaagtcacttcacaaattcgatcattcaccacttatagctattgtaggagcaggtcgtggtccaattgttgattctgcattatcagcaggtgctaaacatatcatagctattgaaaagaatccaattgctgcgcgattactccaattaaggaaagaacaagaatggcctgaaacagttgaagtcatagaaggcgatatgcgaactgttaacgttgataagaaagtcgagatattggtgagtgaattattgggcgggtttggagataatgaattatcacctgaatgtttaatcggctgcgaacgatttttaagtccaaatgcgatatcaataccaatgaaatatacatcattcttagtacctttaatgtcgaattttatgtggagttatgcgaaatcagaaaaaatgttcgatcaaatgtgtattatacctttatcgaaatgtatttttttatctgaatgtaaaaaatgttttgagtttcatcatccaaattgtggtgagttatatatgaaaaaagttatcgagttttgtgtaaattatgagggaatgttgtgcggattcggtggttggtttgaagcagaattattcgatgatgtgaaaatatcaatttcgccactcgaagatgaagcaaatggttttagtagttggtacccaatatatttgccgcttcatgagcaaattaaagtttttccagatgatgtaataaaattggaaattgaaagaaagggaaatgaggattatgtgtggtatgagtggaaattattggaaccgaaagaacttgagatacaaaataaagatggaagtacatttaaaatgggcttacatgttgaagaataaaaattattttcggttaaacaatttcatactctcttcaataataacgacctttcttccttaaaagaaattcatgatttccaatttctataaatgcatcaaaaacataaatcacattcgcatttctaattgtacttcaattcaacctcaatttcatattaaaatattaaaaaagcaaaatcaaaaagttaataaaatatatttttataatacaaatggatattaggcattgtttgatatttgaatatgaacaaaaaatcctttatcgtattgtcattcgcttcattaattattgcattttcttcatttttatgtttgtttcgtttataaataataaatatagcaagaaatattaatattgcaataataactattattacaataattataataataacaataccattcaaattagttgtattcaaaaacatttgtctgatcaaatgtataaagcatcgatacctcttgaacagcaacatgcttacctgcaaccgcacccacctcaggattatccacctcaagcttatattcatccaagcatgcaagccactccacaatatgttccaccatatccttcatatcagccacaagcatacattgatccaaaacaataccaacaagggtattatcaacctaattcatacaattatcaaccacaaacagcaaactatcactatgatcctaaccacatccaatatcacgaaatgcaagttgagcaatgggccacaattccatgtgatcaaacagcttattcatgttattgggaaaaccaacaagcctttgagccacaaaattactcacaaaatgttaagaaagaaaccaaatgcaacgatctattctttgtgatattattcgtcctcaattgagtcttgttgccacttttgcttacttttattatattcttatcgccaagaacgaatatggatctactgaaagtatatccagaatatttgaatcattctttgatatagatgagatcaaagttttattcatcggaattgcgattggtgttgtcattaacattgcccatcttctttatatgaccttccaagcgtttatattcgttttggtttctttatctgtattgttatttcagttgttgtcattctagttccatcatttctcttttgcttttatgttctgtttttatatcccgcaataatttttttattgatttgtttatgttgcacacgtgaccgcattgagttttctattgccgtattaaagcaaacgtgtctaattttgcttcgtaacccatccatcttcttatacatcttcattgtagtcattttcgacattattatcacttgcattttttcgatgatgatcttctccatccattacaagtatcttaacaatgtgttatatatttacttagtcttatcttactattggatttcatatacattcgcatacgtcatctacgcaactgcatctggtgtagcaggaacgtggtacttcctgaacgacacggaatacatgcccgagtcccccgtatgggaatccttcaagcgcgcaatgaccacttcattcggcagcgaagcgtgcgccgcattttggcttgcaattgctcaagcatgtcgcgcagttatcaatctgaatgacaacaacaaccaatacctcgctatccttcggctcattgcgttatgtatcttatgcattattgaatgttgtcttcagtggatcaatcgttatgcattaatatattgctcattgttcggcgtgccatttagagaaggttgcagacgttttatggaattgtcttgtaacaaattcgctgatgtgttattcgaaggttcaataatctcattaagtaagacgttgcatttgatcgtattcacattagcaggtttagccgtaggtttcggtatcggatatgcgatggatgatgtatatgattgggtgttcgcaacctcatgcatgttcgcgctgttctttacattttcaatatttttgatagtcgacttcccattcgaaggtatgactgacactttgttcatttgttttgttgaagcacctgaaaaattgaagacatcggcgtcagagttatacgaaagaatgaagaactctttctctgattcaatgtataagaaacttcattaagtggaaaaaaacatttttaatggtttctctcataaacgtgattttgacgtgaatatctcattttccccatttttttcttacaactcgattcctatcatattgtttcagttttgtctataagctttaatttgaaaatgaattttttatcaagcacaataatgcctgcaatttatacatgtatacatgcttttacatgattgtggtgaaaaaagtttatttatcttcataaaataataacatatattaaattcaaactttgatcatgaatttttaataaaatataaaaaagttcactaaaataagattctattgaagattcttttttttcaatcttcttttgtatctttggttcatctttttgcttgtttttgctgtttagataatatttgatattacataaaataaatattaattagctcttgattaaaactttatatatggttctgaagcctcaagtaaaaattttaattatttcttcaactaataaaacccaaaaatcttttttcgatattttaattgaatgagaagaattttcaaaatcattacaaaattacaactgaatcactcttctataaattttactaattatgaaatgaacactatttatttggttgattctgctcacgtatgaactcttgaagagacattacaacaggttttgcctttttgcgcggtccattatgcgacttaagttttccatctgttgaattcattttcgatttatttccttttgcgcgcttttcttcagctgcgagcatttgtgagaacgaagtattcttctgattattgttcgtagctttgttaacttttgtgcgtttttcttctgcttcgagcatttgagcgaatgaatttttatttggttgagtgttaacttttgtttctgtttgatgattttttgcgcgcttttcttcagcttcaagaatttgtgcaaatgaatttgttaagtgtttactgctgtaactatcagttggcgttttgttaacttttgcgcgtttttcttcttcttcgaacatttgtgcaaatgaagtttttgttagtccattattaacatctttttgttcttcattttcttcttcaagaacttgtggaaataaatcattattaacttttagctttgaacttttatgatttttctcttcagtaacaataattttgggaaatgatttctttttttgtgagctattcacaagtgctctatactcactaatagatgcaaatccgtcaggcgaaggaggccctgttctatgtgatatatttttgctgtctgcactaacaaaattatgaattggtgtctttactatttgctttggtgttggtattgttttatgaccgggtttaatcttttgtggaacttcttctatttcttcctcttcttcatattcttcttctatttcttcttcttcttcaacttttttggctgtttgcttcgtttcttcttcatttaacggttctggtttaaactcaaactcaaatactggcgcttgtgttacggtttgtaatggcgctgtagcaactggaacaccaatgagcggatattggaattgaggggcttcaattggcgctataacagttggtaaaaaattgatgactggctctggataaaaaccaggtggatatcccatgatttggatgctttgtggaatttcaaatcctggtggatgatggtcattggtagttgacgaaggaaatgagtttttgggtaactctactggttgataattattgttaattgctgaaggaaatgaattttcgtgagtgtcctgcgattgatagtcatcgttggtggttgaagaaaatgatttttcttgggtattttgaaaatgatcattatgtaacgttgaaggaaaaacatattcaggaacttcttgagagtcgtattcatcttgtacaatttgtggaaatgattcttcttgaaaatcttcttgaggaacaaattggggaataaaattttcgttttcaagattttcattttgataattttttgcccgatttggatatcgtggcctttgctttataggtctttgataaaatgtacatattttttgtttaaaatttgataaatctattggtgtttgcaattcatctgaataagcaggaccaaatagttttttatctacaagtggttcgcaaggtttaaaaaaactttttatttcgtcatgtgaaaattgtactttggccattttgagaggatcggacatgtttgctgaaaattctggggtttaagttctcaaaaattcagagaaagaacgtttagaaaacgaaaaatggaacaaagcgacgaaccaccagaaaaactttatatgcaaaatctacatttcgaagatctaggtgtgcatcgtcgcgcggctcttcaattaattccttatgttagtgatccagaacttaatcatcaaatgaagttttctaaattaaaatcatctcgttctttccacttcatatcaaaagacaaaataacactttccggtggatataggatatgtcgtaccactcgttttattccttttgatggtaataattattactttgaattgactttcgaacgtactaatgataatagccatgttagatttggaatttcaacacttagtgccgaaattgaaagttccgtaggatatgatgaatatggctattgtgttcgtgataaaggaggtgcatttcactgtggaaaggaatacccttctcctccattttcacctggagatgtcattggaattggtctatttcctgataatgattcttttgcattcaaattatttattaatggtgaagacaaaggagtcatctttgattctataaatccaacagagttttggtttccaactgtttccatatatgaagaggctgttgtaactgctgattttgtgcgaccattccaatatgatcccggagattcttggaaatctgcaaacgatcttccgcgctatcagacgtcagacctgttcacatcaaggtacctcgtaaatgtgatgaaaggagaaataccagtaccaaaagaacatgaaaaagaaataatggatgcgatggacgtggccttaattccaagccacataatgccaatataatttttatttgttttcaaatagaaataaaaaatattgttttattattcgaatacacgaaatgtttttgatttataccattatagattttttgaaaaagaaaatcattttttaagatacatttaattttcttgcgcaacaccatgaaattcacaaaaaaaaaaaaaaaaaaaaaataaatttgttacattctaaaatagtttgccgttaggcattatttggatctagaaagtttattttgaaataattttacattttaccatatttatttttaatttattttatcttatttgtctttgtaataattgtttaattatgaataaaattttccaggtaaatattccaaaatttgcattttatttatgtttacataaagcacccaaatttttgggatttacaattgattttgatcgtgtttatcactttttccataccattttttgtgaaacaatgtcacttttattgtcataaccaccgttattgcggttgttttaatttcgcccaaataattaaaaaatgaggagatatttccttccagaaaatatagataatcaaccacagcgccaagaacaagttcaagatatgccacaacttccaccatatttttctatttcaaccacttcatttccaagttcaaaaaatgtaacaaatataccgattggtatatctatatcaccaaacggtcctcctaacatacccgttatcgattatacaaatcgctaccatgtaagatgtaatttttgccatggttatttatcttatctttgcaaaatccataattccaaagtttggaggtgtcctctttgtggcactgattcatcactacctcatggttttacacctgattcaccagaaatacattatccagtttatgatgttattcttccaaaatataacaaaaccgaagcaccatttaagaaaatattcacgattgctattgacacttctaattatgatcatgcaaaagtttttgttaattcacttaaaaatataattcaaaaaatgagtgatgatacatgtctatatttaattacatataaccaaagtatcacattatatgatccctccaagaaacgtaaaatagtttttagtgaactcgaaaatttacctattccaccaattaacgttcctccgttaagggaaacgcgaccattttacaattcaatttttgaatcattcacttcacaaccgcaaccgccaacatcaaaagcatcaaaaattaaattactttttacatttgttaatgagttaattggcgataatggctgtgttctatgtgcttttgttgatggttgtcccacagatatacttcaaagacaacaaccgacattttcatatcctgataatgaggatgaatttcgtgatttatgtttcaagttaaatttaaacaacatttctgttcatatctttactaatgctagtaatgaacgaaataatgaatcctcaatcacatcgatctcatcaggacttacatctggaacatttcatattattgctaatttaaatatatttaatattgaactcgaaaatgttcttacacaaaaatattattggaagagttgcggtaaacttagatgtagtcataaaattgaagtcacagaacatttaggaaattgtgtcatccataattcaggcgcttcatcatttggagcgtttccacaaaacggcggaatcacgtacatattaaaattaccggataaatcaattcaagatcaatatgtatatttccaatttgcgatgttatatcggaatgatgaaggtactgaacttgtacgcatatttacatatcctgtcaaagttagtaatgacatttcaacaagtaattcgatatggacaattggcctaaagaaagctgcaaatatattattaactaatgacatcaaaaactctaaaagatatgtcaatagtttaataccaaatttaacaaacattaataacattcgaatgttcggaaacgatatttcattcgatcaaaaaatatcggacatagtgttcattagaggcgcgcggccaatagacataatactgtacatattcccgagagaagaaacttctgaaatttgcaaattctgccaaaattacgaagcggtgttcattataacggataacgaagaaaacgaaaacaaagtaatcgaatcaatttacggaggagaagtaatggaaaaagtgccgaaactgcagaatgagtacaacgaaagttttcataagttttacgatgcggcaaagtcaatttccggggtgggcctgattcctgttgtatttgtaagtaacaaataaatgtcatatctttgtttgcgttttgtaatgaacgttaaagtcataacaatgttttctgatatttggatatacagtttgtgctctggtttggaattaattaattaaattgatttctttgaaggaatataagatacgaaatatatttatatgtcatttaatttgagattttcattatttagtacacaaataatatgtgttttttatgctttctaaacaaattgttgtatatgagggaatatgatgaaatttatacttttgttgtgttactcgttttattattaattcgtaatgaaaaataaattagttgtaatcttgaaatgaagaaaaagaaaatgaaacaatttcaacattttcatccgaaattcatatgaataatatataataaaataaataacttgcgagagattttagagatggtaacttttttaaaaaaattcaattctgataaataaaaaagttcggtctaatttttttattgattttatctaaaagatgattgtgctaagataaaatgtaaaaaagaaaaaatatgctctttcataattaacattaatattctcaaaaatatcttccatggattccatatttcatgctgaaaaattgaatatggatacatcttttaaggtataaattcgctttcttaactgatacatattttcaaatcaaatattaagatattttttaaatcatagatgataaatctctttgcattttaataataatttttaaggcttattacaaatattgaatacggggaatcggttattcagaaatatgaaaaatcgtaatttagcatgaaataataataacatcaataaaaatgagatatcatttcattcaaaaatattgagtatataaagtaaaacttaatacaaagcataatattgagactataataaaaacaaagatgaatttttagaacattggcacttttgaacagacgttaaaattctaacgtttccaatctaaggaatctaattgcttctacagcgatgctccaagcagttcaagcaacaaaagtatggtttaaagcagatgctactcttgcgcatgacgataagcctgtttgtcttagtgtacatctactaaattgttccattgcttcttcatttttatacattgaagactcatccaattctttttgtttcataccaattacatctgaacttattccttcattttcatatgtcaacaaaacatttacacttcaatttgcacgctatggaaacatcacattaacattcaaattccgcaagctagtagatgttgaacaaatggtatcacattttggcaaaacctcacttcttatgaacacaacagatgatcaatttgtttctgaaaatctttcatatctacgaaagttacgcggatcctcagaaattcccaatccacccaatgccgaaccacttggcgatagtacagcatatagtcctatcccatttagttcgtcatgtcgtgacatctgggagaagcgggtcatttcgcaaaacactcaattttacatcgatgaagttccccttacattcaattttctgacgtggaacgttgcaagtaacgaagccaacgatagtgttttagatgatctgaccaaagtatttcattcgcccactttgccatccgatgttgtcattattgcgttagaagaaatcgacatgtcatttaagtctgttgtcacaggaaatagtgataacactgagttatggactaaatatatcttaaaagcgcaacatattgcaagtaatgattcatatgaagttgtagcacatgattctatgggtggcgtttattgttgcgcattagtgcgtaaaggattaaatcctccagttaaagaatcatcgatacaaaccaaaaaacttggcgcgaatggaatgttagccaacaaagctgcagtctttttccgcatgaacattggcgagatgtcattagttgcaatttgttgtcatttagcaccacatgatcaaaattgggaacaacgtaacactcaatggcatgaaattgtttcatatgaaactaattccgattacatcatattcatgggcgatttaaattatcgaatttccatgacgtatgaagaagtcattgataagatcaatagtaaaagtttaagtgatttatatgagaaagatcaattacatatcactcaacaaaacgacaaaatcattaatgcatttaaagagccgaaaatattatttaatccaacatttaaatatgacttaaatagtaatatctatgatacatcaccaaaacatcgtgttccatcttggactgatcgaatattaatacgtacgtcaccgaaacgtattaaaatcggattagaagataagttaatctttgaaacagatgctgcgcatcatttcatgaatgaaacgaaacttttcattactgataattatgcgccaatgtcatttaatgataaaaataattatccgagtgaaccgcattgtatcttttatcgaagtttgaaatcaacatttagtgatcatagacctgttcaagcatgttataagtttacaatccctgtcattaacgacgaaaggaaaaaagaactttcgaatatcatcgaagagaaatttgatgaaatgcgtttgttaaatgtgccaatatttgaattagataaatattctattgatagttctgataaagtacaacaagaaattgtaataaagaataaatctttggtgtgggtcaaatggaaaattagaaaagatacaataccaaaggatttgtatattacacctatagaagggttgttgaaagtgaacgaaacagataaaattaaaataagattcgataagcctttgaaggaagtcaaaagattggtgataaaggcacaaagaggaaaaacattgtcagtgcaattgttgcctgaaagatggatagatgtggaacaggaaaagttgaagagcccattcacaaaataattgttttgtaaattgttttgaataaattgaaatcgttggtatatttgtaaaatgagaacttttcgtttcattaaaattttgaaatatgtgaaaaaacaaaaataacaagcaaagaataggaaacgtatgaacattagatgtggaatattttgaagaagatactcttaaaaatcgataaaatgactttttgcatgctttacatatttgtatcgattcgtttatttattcaaaatgaacaacaaaagagaaagaggtgaaacaaatcaatctcaaaatgaatgggaatcatttgtaatgctcaaaaatacaatctttggtttgaatacagagaattttattcaatcatcgaattttataatcagcaaattttgtaaagagtattcaatatcttataatataagtataagccgaatgatatataattcccttttgatcaaaagtaacaatttcgatatatatttgagattattacaagaaattgaaaaatttgaagaaaataataaaatcacttcaaaaataatagactcattttctcaatttcttcttagaataaatacacaagaatcattttactttcttaattacatgattaattataatttacttgaagcaaaagtcattcaaaataaatgcgaatttccatttttcgctcacattaatcaagataaatttgataaatataaatattcatttgatcaagaaaatattgcttgtgaagaactttcgaagaatgattttgcacttcataagaaatatattaaagagggacataatccaaaagaaattgctaaaataattcgaaatgacgaaattgaaaaacttcaagaaatatcatcacaaaataattttaattttaatcaaacaattccaaaatcaatttatgaaagatgttcatttattaacaattggaatgttacattaattgattatgcagcatttttttcttcagttaaatgttttaaatatttacttatgaatggtgcaaaaacaaataacacaggtaaatatgcagttgcaggtggaaacattgaaattgttcatttgtgtgaacaaaatcattcatcagttgaagatgcatatgaaacagcaattaagtttcatcgaaatgatatctttaaatatatttatgaaaacaaactcgaaaaatttaaaaaattagaagaattaggagtaatatgtgtttcatattttaattatgaaatttttacatatctagaaaatgaaggaatgaaaattaatgtaaatatcattaatgaagcagcaaaaatcggaaatatttttcttgtaaaatatttccttaaaaataatcaacttccagaaaatattttagtttttgcttcatcttcaggaaatattgaacttgttacatacattctaaatcaaaaaggattttatattaatgctaaaaatattttttttgttttatttaatatttattttaatgatttgatatttcaaaataatatttggaaattatttagattattttatacagcacttataattgcatctgctcgaggtcatatagaaatcgttaaattacttcttaaacaagagggaattgatattaatgctaaaaatatttcaatgttatattcaaaatttatttttatattattatatttcaaaataatttttggaaataatttaaattatttcaatcagcacttatttgggcatctcaaaaaggttacatagaaatagttaaattacttcttgaacaagaaggaattgatattgatgctaaagatatttatttgttttatatagaatttattttaatattttgatatttcaaaataatatttggaaattatttaaattatttggaacagcacttattttggcatctagagaaggtcatacagaaatagttaaattacttcttgaacaagagggaattgatgttaatgaaaaaagtatttttttgttttatttaagatttatttttattgttttatatttcaaaataatatttggaaattatttgaatcattttatacagcatttattaaagcatctgagaatggtcatacagaaatagttaaattacttcttgaacaagagggaattgatgttaatgcaaaaagtatttttttattttatttgaaattttttttgataatttgatatttcaaaataaaattcggaatttatttaaattatttgatacagcacttatgcttgcatcttggaacggtcgtatagaaatagttaaattacttcttgagcaaagaggaattgatgttaatgctaaagatatttatttgttttatttaatatttatcccaacaattttttatttcaaaataatatttgaaaattatttaaattattttggacagcacttattagagcatctgggaatggccaaacagaaatagtaaaattacttcttgaacaagagagtattgacattaatgctaaaaatgtttcaatgttatatccaaaatttattttaataatttaatatttcaaaataaaattcggaatttatttaaattattttatacagcacttatatgggcgtcttataatggtcaaacagaaatttttaaattacttcttgaacaaaaaggaattgatgttaatgctgaagatatttatttgttttatttgaaatttattttaataatattttatttcaaaataatatttggaaattatttattttatttataacagcacttatatgggcatcttataatggtcaaacagaaattgttaaattacttcttgaacaaaaaggaattgatgttaatgctaaaaatatttatttgttttatttaaaatttattttaataatttaatatgtcaaaataatatttggaaattatttattttatttataacagcacttatatgggcatcttctgaaggtcatacagaaatagttaaattacttcttgaacaagaaggaattgatattaatgctaaagatatttatttgttttatttgatatttattttaataatttaatatttcaaaataatatttggaaattgttcaaattttttagaacagcacttatgatagcatcttctgaaggtcatacagaaatagttaaattacttcttgaacaagaaggaattgatattaatgctaaagatatttatttgttttatatagaatttattttaaaatttcaaagtggtatataaaaattattcgaataattgaatgaagtgaacatgggcacaattttgtaattcattgactaattgttatattcaaaggttttgtggtaatatcaaaaaagccatatagtacacatcgaagacctacatttttgaggatattttatttaatacaaattctttgcatatatgtaataattctaaaagtgtaacttactttcgtaatatcactaaaatttatattgttgcttaattcattgtgatttacattaatgtgacttgaaatttctgacagtacaatatcctaagttttctttgtaactcatgattttggaatacgtatatgtattttattgataaactcagaatagctttgggattaatcacacacaatttttttggccaaaacaacttgattgataactttttgaatctattttgatcctatcaaatataaatttctcaaaaagtggatatgtttaaaacgttcgaatttcttcttcaacacttttgcaatgaaaccaaaaattttaaaagcatttaacgtaaggaatggagaactaacttgtgccattccattcacaaataggtatatagctggaggaaccactggtaagagcattattttatttccacttaacaaacaagatacatgccaaagacttgttggacatcatgatactattacatgtattgatgcatcaaattcacaaagtcttattattactggaagcaaagatgaagaaatccgtttttggaaagttattgataataatgattcatgtataaaaaaattatctccacatttcggttccataaaatctctatctattacacaagatgctgatcaggttctcattttaggtggatcatcttctctttctctttttgatataaatactcaacaaataatacaaaaatttccaatcacagataaagagcttagttcaacggctattagcttatatagttctttagttgccacaggttcaattgatggaaagtgccgactttatgatattcgaagttgtaatattcttcatacttttgatacatattctaatattctttccctttccttctcaggcggtggtgataacctcgctgctggaacttcaaatggctcacttttcttatgcgaatctaaatttggaagtatccttcattcatcgaaaatacatagcgactccatcaattctgttgccatacagccaaatggcaatataattgtcaccgggtcgtctgataattctgtaattattactgatacaaataacttcgagtctatatttactctctcagcacatgagaaagatgttatagatgttaagttttcgagtgatggtaaatattttacaacttgtggaagagaccgcaaagtgatttattggttatcaccagatctttctgtttcgccagaagaagaggaaattagtacagaggaaccaagtttggattttcaggagccaaaagtaggaaaaattagccatgaaaacacatttttatcccaagattctgtttttcgaaatactcaaacaaaaacgaaaaaacgcaaaaaaccaaagcgaaattgcttggttagagttgtaaaatgcgaggaaagagtcaatgatccttatcaaaatttcctttcagatatagcaaatgaactggataaactttctgttagactaggcaagattacaaagcgcgtaaaacacaacgatgaaagaatcaaaatgattgaattgaaatcaaaataataataattttttttaagtgaactattttaaatttccaaacatacactgcgcttgtacattatgaagccattggtctcttcatgtagtttgacttttttcattttgttgaaattaacttatgaattatgtttttgtacaaaactaaaatcacatagaaatatcgtatcacattgcaagggttactttgaatttaaaatctcgcccacgtaacacgccttacatcatttttgggcaaaatttggatggggtgccctaatttcccaactttttgaatgcagattcaatgtgaacgatcaaaatagcgtgtgaggatagaaaatggtcattgaaaacattatgggaaggaaaagatatggctggagacaaatcaaggcaatagtcatcagtattgatgatgttactgtgtatattccgcttgtcgaagagaagatcttaaaaaaagatttggaagttctcgatgaagttcttaaagatattagggaaaaaatcaattctagaactaatgtacaaattccacaatcacaaccagaacaaccacattttaatccagatcgaatggatgaatcttacgatagtgaagatttcgatagatttttttaagttgtgtttaatataatatgaaaaaatttattatggatactaaaaatataattttttaataaaaaattaaaaaatgaaaatttctcgaagatagtttgttataaaacaaattcatttatatttaattttcaacatattatgttatcaccaaattgaaaaaatattcgaaaaaaaaaacataaaaatatatctgatcatttttattgaaatataaaaataaaaattcattattttttaaaatataatccgatgacataaaagaatttgattgtgttggttattatgttttaatttttattatttattgcaaaaaatgaatattttggaaattacagcacttttacgattataaaatatttttatttttatatttcaataaaatttattggtataatttttaaaacaacgattctaagttatgctaaaaataaatatctaaaataaaccaggtcaccactttatataattttattcatcaatttttaaaaaaatgggagaaaaaaatgaaaaatttgaatgaatttttttttcctggtgggtttcaggtcctaaaatcaatacaatataaaatatatcataaattaatcatgaatgactggaaaaaataaattttttaaaaaaatcgattaaaaaatatatcatgagtttataaaattttatgatctaaaatataaattattgcatagttcatggaatgcttacatatggaatgaaaaaagaagaaaaaaaatctgttttttgggagttgaagtacctctagtatataaaaaaaaattattcatgaagtaattataacgatgtcaaaatatgtaaatatcgataaaatatttgggatttacataaaaaaattttaaaaaattcttgtgcttgaattttttgtaattacactaaaatttgttaatttactaagcaatgatgtcattatgcaaaaaaatgtgaaaaatttttatatgtgcatttctttaacaaatgttcttattaacttaattgagataaaaactgaacaacgacgttactagctcaaatgagagggagaatataattagtaaacaatacattggctatttagtaaattaaaactgttttgatcatttcacatcacatatcattccatttgatagttggtcaaacaaagttaatcaaaatttcacatagttaagtattattcgcaatgtttgggcccgattcatcaatgactgagcatacaggaacaacaatcttagcaatccaatgtactgatggagttgttatggcagctgattcacgttcaactatgggacaatatgtttcttcacgcgcttctaacaaaattacaccactttcaccaacagtatacattgccagaaccggaactacagctcacactcaaacacttggtaagtatgcaaaatatgcattaaatatagttaaaatgaacacagaaagagatgttaatcatcaagtttctattgccgctcatcacctctcaaggttaattcaaaataacaaagaaatgcttagtgcaggatttatttgtgctggatgtgattctgatggtcctgcagtttgggaaatttctgttagtggaatggctttgaagcgtaaatttgctgctaacggtagtggtagcgcatacattacagcttattgcgatgataattgtcaagaagatttcacaatggaacaagcaacagaatttgcaatttcggccgtcaacaatgcaatcgtccgtgatggagcctctggcggattcatcaatgttgttcaaatcaattcagaaggtgcaaaaagattacttgttatgccgaaagaccaaccatttgattacaggatagttaaaacataaaaattttcagtaaatcattttttggcataatatttatgctaatttttaaaatttttgaaatatctgatttcaattttatgatttttacccaataaacttaaataaaagttaatagtgcaaatcaattgtaagcactgggactcaaattaaataatcaattgatacttaagagacatatccagattggataataatctttatatactttaagattttctttttctaagacaaacaaacaactgaagtatttaaaccaattccatttgtttatgaaaaactttattacttcataaagacatgttttaataatttttgatgaactccaaaatttaaggttaaatttcaatgaaaaacaaatttatcattgatattacattttccgtgtatattatttgataaatgaagcaaattcccacgtgatacaggcctttatgttcataaagtgatataaacgatagattgcattttttgttgtcactttttccaatatgaaaagtgttgtttgttgtcttttgtgatccaaatgattatattcctcacatgaaattttgtatttctatgacattcattgattaatagattctaaatttcatcaaaataataatgttaactattttcgacaacattatttttatatgacaaaggaagctgagacagatgtttttgagcataatcccaataaagagcgcatatgtatttacgagttttaacaagtaacccatcatcatgaaaatgtattttaatgatccgtaaggttttcattgttatactcaaagatatgtctgttagccaccaatatttcttgattcatgattagatagttctcttttatagcaatttttaattcattttcatgttattgtggccgagcaaagacaaaagtgacagataaatcagatgattttttgtgatcataaaaaagaataaatatacaaaaattaaaattctcttcaatgtgtgttttagttgtagtgtgctccaccagccttgaagagacgagcgttgatttcatcttcgtctaattcgtcaagggaatctgcatcgaatgaaattgagatttggttgatgaccttttcaacatcacctctatggatgttcatcttggccttgatgttcatgcgtgtgcctttggcgatgtatttgatgaagacgaatttggaacgaacggacatatcatcaccagttgtaacacggaggtaaccatagccgatgaacttgtcatcgatgttagacttgagttcttggaaaccaccttcacccttgccaacaagagtccaaactgtttggttagttccttctttgtatgtgataagcatccagttgattggggatttgtcactgcggacttcttcgtaggcttgaaggatttctggatcagagcaatcagacatgattgaaaagtgaactgttcgaccggctttgcggttttgataacactgaacggacaaatgatattggacaattgtgtactatgttctgtcaacttctgaaaaagtggaatcacgatacacaaaagttgtgtaaactattgaagtggaagtaaagttactaaaataaaaaagaaccatttattgagcgaagattattatcattttatgattatgaggaaaattaaggaagaaatatgttcaatgaatatttcaaaacccattttattaaaaaattaattgatatgttcgtttttttggaattttagatcgaaaaagaagaattattcaccttgtcaattgtcttttctatcaatattttgtgccatgtctaattttgaatgctttttatattatttatttcgttttttcttttcgtttttttccctgttaaaaattaaaataagctttttattcatgagaattatttcaagaaattcattttattaatgtcaaaaatataaaaagatgttaaaattaaacattttcataataacaacgatttgttaaagttattaaaatttactgagtaactggtgtttcaatctgaattggagcttctattggttgcttacctccataagacctaataaacaataaaggaactaatccttgaattaatccgacaaagagaatgctgtatgtttgccctgttttaggttttgtttgtataccggactgtgaattaagagtctttattgtccaataaaaagctgctacgaccgaatatgctgttattatgtaaagaacaactttattccaacaaaacaaggtacagagggagatgtgaacagaaacagagcagagatctgcaaaaagcgagaaaattgtgaaagttccttggaatccaacaatgtaaaataggaattttgataaaacaacttgaagtacaacaataataaagaacttacagaaggtgtatgtaacgcgctcaaacgagaatgtatcttgaataatatttgccaatgaaattataagaatgaaaaagaaagcaaaaacaagtggtgtatatagatctggtgcattagggttagaagttggagtagcttgtcctccttcatgcccagaacgactccagtttttaacaataaatgggcatagaagtgatttcaacttttgaagaactgatttcgtgtttacagcaaataacggacgtattttagattgtgtttgtgcaatattttctctcatttcttttccatactttccaatttcagaattgataattgcagctgctggattttgtgccatacttaagtagttttgagggttaagaagtgtaaaattaccaagttcggatggagggctttgtggttcggatgaattaggatcattgtcatattgctctggatcagatatcattggtaattttgggctgttgatgaaaagtggcaatgaaatgttacataaaaaactttttcatcaaatcaaccacatcttatccaatgatatcaattttattaacgaattaaaattcttgcaataaatcaataaaagaaatttgttttgatttttacttaaaagtgaattctattttaaaattaattattaatcataattttttatcataaaattcaccttaaaaaaactctatagtatttgcacccaattcctaaaaagtcaatatctctgttttagaatgtacttagttggaagacagggattttgatttaagatttcgtaaacggccgttttcatatttcggtttctgatcggattatttatggatacaacttcagtaaacgttggttgtgggctaatcgctacagcacctgttgttgctgttcattgcgtccttatctcgaaatatcggtttattttaattggttggttttcatcatttatttctacaattcttctgattttttgttctttatcagcactgtttacaaataacccgtggtatatcttattgttttcaattcctattgacaatattgggaaaccaattctgaagtattttggatataaacaacaatttttagcttcaccaaatgatcactcatctctaggactagcaatgggaatgggatatgcattagcgcatgttcttatattatatcttccaatggttttcaaccaaccattttctttagagtttgatgttgatcatccaaaatatcttcctaattctctcgacttagcactttccaatcatgctatgtcaatctttcatatggctacaggtattttatatttcagattttcagaatggaacatcttcttaatgtacggcatttgcactgttgcacagtttgtcattgccgcagtgacacaaatcagaattctttggcttaagtttattcttttatttggagctagttacggtttattctttttcgccatttattcactcagatcaatgaaatatacaaaacttgaagaaaaagatcacgatgaataattataaataaatttatttttgtttaatttttttaaattatcaaattacttcataaatcaaaaagtatttccaataccaaagacatttacttttattattttgctttgtaaatttagtgttttaagataaaaatcggaaattgctctgattatttagttgataaaaacaaaatttaatgtatcatttctgaattggttttctcttaggcaagttgacttgcccaagcacaggcggctttttcaaatccggtctctgaacatcttgttgttctacttctggattatcaagcgaataaacggccgctgagaccgttttttctatcgtctcttctctgccgtcccaaataaccgtatttttcgcaggctctggggtgcccctagcaaattgtgctaagtttcttgcgatttcatcgccttgtgccaaagaagaattctgattctgttttctctctttcattgttgctagttccttttgatactgtgggtgctgtagttcaaaccttaaatgatctccaaactcttcgacactaactttttgtcctgtgattggagaaatctgttcaatttttccttgcttacgaagagttctttgaacaacggggccctctggaacttcttgcttttgtggttggtcatcatcgtagtttattgtgcctaaaacgtgaaattcatcccaatcaaatgcatcagcagattcatcttttttagcttcaagcgcttctttctttttctgttcaattgtcattttttggtgttcagtttcagcatcgatatttgactttacattgagaaatgaagctgattcttgatctaatcttcgtcgaatttgatttgatgggtcaatagcaagtttatattgctcatagagcccagtaaagaatctaaagtatggctgatttggcttgagaaaattaaataaaggtgattctgattctctcattgcaatcgcttggagaaaatcttgtccataaagtgccgaatattgagcaacaagatgaattacgtcgagttgtaaaccgcctatttcagtcggttgtttataagtaaaagatggctgtattatttttggaattggttttggtgcttgagcgattggagtaattggttccattgctgatgctgcggcttttttggcaccacttttagcttcttctaatttcatctgaaagtatggataaaatggatcttctggaataaggaaagaaaactttggattcccttttttctcctcacgaagtcttgtctcaagtttttctccaaactttgcgatatagtctgctattttttcgattgttttacatacagcttttggtgggatgattaggtcgctcatgcctgaatagacgagtcacttttttataatacacctatcgtcctgtttcgaacaattataatcgaaattgctggtttgactgttggttatttaaattattattgtaacaattatattggaaattattgggtctgcatctaattttattatattctcatttattaaaaagtaattataaatgtgagagataaagtgataatttatatttgatcattttcttattaccatttatgatcaaatctgaatcaataattattaataattcaaacgatatgaatttttttccttatctataacgaaattaaccgttaataccaatcaataaattgttaactaagttaacttaacttataattacaggaaaatatttaatgactcaaggaatacttaaaaattatttcataattaaagatattcacaaagacattagttatatgaatgctttatatataaaataatatttattgcatttatctagagcagaccttattatagctgataaatgtaaaatattatatatatatatatatattattaaagttcaatcaacaaagatcgctgaaatttttttttacattaagtaataaaaaaatttaatatttgataacaatgaataccaagctaaatataactttaattgagaaaccaattcgcattttcagagaaagcatatgtccttatatcccatttttgggaggttacataataatttctcatcattgatgaggaaaatgttttttgataaaaaggtaccaccaggtaactgagaaagcctccttaaatagaatttttaaaacaaaaaattcaaacattaaataaaaaccaaggtagcacactttgattcagagtatttaaatgacagtattctataataatatcatttcaacattaatgttttatagaacaaaaatattttttgaatgcttgcattgtatcagatgtactattgataggaaatgaacattaatatacggacgatatctcatacgatatcttcaaagaaatttgactgttttatacaataaaacggaaagtgccaatgaatatcattaatctcacaaaatattctatgagatttatcatttacaaaatttaaatcaaaattcaaacacttttatgtaacacacagaaaatttggtgtaaaacatcacatcaccaaaattttcaccgcttttcaatgttgccaacggctcccaaattgtttgctatatttaaccgttttctccaggagataatggataattttcttgattcgcttttcactttaattttccacttaatgaatttcaaaatgcgatctctttatgaaagctaaccaagcggtacagttttgcaatcggtcaacaaaaaatttgaagaggagagaagaagagtacattttatgttggtccaattattttttcaaaattcatttcaaaaattgaacgcttgcactttttgaattgacaaaacttttttcttatcgtcactttctttatgtcaagcaaaccaaaggttatcatccttggtggtactggatttgtcggccgtcacatggttcgctatcttattgagaatgacctcgcttccttgatcagggtttgcgataaaaatcgtcctgaaatgtcctggtttactgaaccagacttccaactctttaagaaccctattgttgaatacaagatgtcaaacttagtaaatgagcaatctgttgagaaagcattcgctttagacaacaaccaacaatttgatattgtcatcaacctcgcaacaacaggaggctatggtaaggacgctgaattctatgaacaaaagatcctcagggttgccactgtttgcggtgctgaagccaagaaacgtaacattccaaaatggattgaagtttcaacaggtcaagtttacgccagctcaagcaagccatcaacagaaacttctcatcttaagccatggacagcccttgcagcctccaaactccaagcagaaaaagtattattagatatgggattcccatgctgtattattctccgtccagcaaccatctacggccctggtgatatcactggcctcatgccacgtatagttattggcgctgtttacaaacatgcgaataagaagatgaagcttttgtggacttcttccttagaagtcaacactgttcatgttgttgatgtttgcgccgccatttggttccttgttgaacatggaaagcctggtgaaatctacaacattgttgataaaaacaagactgatcaaggtaagatcaatgagcttgttggaaagatatttggaatcaagactggatttgttggctctgtcatgagcaactttgctaaggttaacttcaaatcaatcatcgaacaagtcaatgatgaccacatgcaaccatggggtgaaataacccaaaagaacaacatcgacaggacaccattgtctccattccttgaccccgaattgctcaccaactcgccgctctcgattgatggatccaaattggaaagtttgggttatcaaataaaagtgccagctccaaccgtcgaaaatctccgcgaatcaattgattactggattgcccaaaaggcattcccacctctttaagtaaacatacttgagtgggactttttttggaaaaattaatgaaatgtttgagaaatgtgtaatacattaagtagttgtaattatttaaatagaagcgagaattgaaacacttaaatccagcattttattaacatatgatctttaactttattatgcaattttaaattttttgttattatttacagactattatatataatcaatgattaagtatttagctattaattaaataaataattttatttcataattattaatcttggtttattttttctgtggtttatcaatataatctcttgtggaatataaccttacagaggtagttgtaagtcaaaaaatcattgaaattatcatcaaaaattcatctttattttggtaattctaacagcaatatatgcttcatttccatttcttattgaaaatgaagatttaatgtttattgaagaagacaattagaattttcttttgaacttttttctctaagtaaatttacaatttctttgtaacctttttgttgtgtaatttgaattgttgcatcaaattattaaaacatatataaaattattcaaatgaatagtttttgcattaacatcaattcctttatctaaaagtaattttactatttctatattattattcttcactgctatatgaagtgctgtttcaaattattaaaacatattctaaattattaaaacatattacaaattattaaaacatatttcaaattatttaaacatattctaaattattaaaacatatttcaaattatttaaacatattctaaattgttaaaacatattctatttgttagtcataattcaatcacatctattaaataaatgctttttctcgcagttataacttggaatctattatcatcggagaaaatgttacgttcattgaaatgagtgcgtttagtggttgtaattctcttaaatgtgtttgttttaatgggaaaatttgccgaatgttgaggcaactgcatttactggtgctgcagtagttatgacaactgtaacatagcaatgcacaaaatttggaaaattaaatgtttctaaaggaataaaaatcgaaggctgtcttccatttagcaagtcaaatctatttacatgtagtaacaaatttgctcgatcaaatacattttcaaagtcaaatccattcacacgtagtaacaaatttactctatcaaattttctaatttctaattttcacatttacttagtcaaatccttatgtccaaagcaatattttcatgatttcacgcatatgtacgaattcgataatttatatgaaatcaaatacaaatattgattttagttcaaaaacattgaacttgagaatgttcaaaagttgtttatatgaaaatgttattaaatttttttgatatcaataaaattaaataattgtttcatatgttttcatctttttctgctcaataaatgttttaaattcatggaaaatataatatatataaaacaagttctttactctatttcatacaattgtctaatgtattcacccgcattcagatattccatttcgtgatattcttccgcttgaattccatctgatttgaaaacggtatcaaaccattgattggtttgatttgaatctgatatatcgaaaagtggcccaatgacactgcccaagtattgttgcgcactggaaagcatcggatcctcttctggaggttttggttggatattctgcatattctgtctttggacaaatttcaaatgatttaaattgatttcggctccgcacgttgggcatgtacaggaaccactattgaagaaatccaatatgatatccttgaccaagaacaagcaatttttgcatttttcagttttagcaaacaaagtatgttcattaaattttgttccttgcttggactttggtgtaatttcgcggattatcaatgatatctgtttcttttctactagttgaatcacaaaccatgtcaaatagttgattgcattaattgaaggttgaaagctaattcgaatatttgtatttttgcttaaatctgttataagaacgaagtatttttcatttgatccgaaattagtagtaaagatttcctttccgtttaaaattatggaattgactggggtctgtttgtttatatatggacaaatgaaacttccaatgcacatcagatttgggttgtagaaaggaggatgataatcaataccaccaacactaaatggaactaagtggtatgaaatgcttccagcaaccacttttaagctattaaataatatgggaacatatggttctctcagttttttaatttcactgggcttggaatgagtgaacaggtaaaaaagcttttgaatttggggagatggagtgctaggaagaatcgtggtgataaaatatttttctttttcaattcgtgttggagcagtacagccaataatttgaaacaaaaaatccgcagtttcatcatttagagtgctcaacaattgaatagcttgagcttcatgatttactggtggattttgtggaaaatcaataatatttggttgaggcggaggttgtggaatattaggtgaaacagttggagtttttggcatagtatgattatatcccctctttttccctgttgtttgttgtgaatacatttgtaaaatttggttttgttgggattttggaattttagcagttcttgttctttggttttgcacatacttcatttgcataggatgttgtggaggaatcatttgctgtggaaattgaagtggatatccttgattaattggatatgtttgattgtacatcatttgtctgttttgcaaaaatccaggttgctggccttgagggatttgatattggtaaggaggatctggaggtatttgcttttgcatctaaaattttagctccgaatttattcataaccgtttagatgtgatgtgatgtgtgaatgcggacagactttgttaagtttcgaaaatatcaaatataaggatttttttgattgtattttaattttaaacagaattacattctatgttttcaatatatttttatcccattcacattaaaaaatatttttatcaacccaatccaaaaactcagcatttataaaaggccattatcgatcattcgatcattttcactgcctcatctattaaatccagcttagacaaatcaatttgttcatccgttacgaattcttgttccaaatttggataattacattcaccgcaaatcgagcaaaacatttcattcttactatcactacccacataaccttctctagtatgaaacatatgaccacacatgaatccaacataaggtggaccagtgatatcatttttacatctgtcacatttcattggcttgaactcgatatcaatttcttcaatacattctatttcaccagttgtgtaaacatcccaaaaagtttacaatggaaattaacggattcttcgttgaaacgtttcaacgatagcggcaagtggtattgcttttgatgagttttcgatgagctttttaaggaagggttgcggcggggaagatttccatccggctttgcttacaacaacaaacttaaagatttcaagccagtttttattgttgagatcggggttagctttgcagaattaatacaaatacaatttctttatcacattcatttgttacttcatatgttttatcatataataaattaaaaatcataattaccttttattaaagaataaagtataatatcattaagtatgtaatatactttaaaaataatgcattctaaatgtttgaaaccaatttaaatgcattctataaattgaatgtgtaaaacagtgttatacaaattaaattaaaaagaaaaggaaaaaggaaatattttttaaataggtttcttaaagttcttaaagaattttctcaggacttctcttactttgctcttttttccgtttggtgtttcaaatcgatgattaaatattgatgggcattcctcaaatgtattttccttcaaaatttccattctaccaaatcttgtacttttatacgactttgttactataacctttgatgcattgatattgataaaggaatcgatgctaataattggttctttctttccaaaataatatatacatttaagtgatttacagccagcaaatgcttttgattcaatttcacttactcttcttccaatagacaccatttttaggtttatacaataagaaaatgctccatgttcaatttttttaactaagtttggaatattaatttccgttaagttagtgcatcctttaaaagcattataacaaatttcaattaaaccttggtttaaattcactcttttaagattaacgcattcaagaaacgcaccactaaatataaacccaatgtttgatggaaatgtaaattcatcaatattttttccttctggaaaacgaattattttatgaattgctttatcatataaaattccatcatcattattattagaataatatgaattattggggttaacttctatacattccaatgacttacacccaacaaatgaattagaaataattttctcaactgaatctccaataaatatctttttcatttttttgcaattttcaaatgctaaatatcctattgatagaattgaatttggaattttaagttccaataaatttatgcattcggaaaaaacaaaccccttaatcgacttaacattttctccaataataatcatatataaatttatgcaattagagaatactgaacttccaatatgataaactttatttggaattattatcttttcaattaatatgcaatatgaaaatgcacctttttcaattatttttagattttcattaagataaacatcttttaatgataaacatgaacgaaaagctgttataccaatatcactaagtgcttttggcaaatgtattgattttaagcaaatacactttgaaaatgaattatctccaattgtttttatatttggaccgaattcaatgacttccaaatttttacatccataaaatgctccatcattaataaatattgttgaattcataattgtaacattaaccaatgaagcccataattcaaatgcgaaatcaccaattgtatcaactccttcagaaataataagtttatgtatactatgattccgtaatacatctccaaatttgataattggaatatttgaaataattagttcattacctaagaatttctgcagagacagaatatgattcatcagtgcaaataatataaaaataatagataagttattgatcatcaataataaaaatgatatattttatcacataaataatatgcataatctaatttattaaattataagaaaagtttatacaaaatctacttagtgaaaatgtttttgatgaaaaaaccattatattttcattctctcaaaaataattttaaaaagtattcacaaaaatgatgatacatcaaattataggttgtatacaaattattataaatgaaaacaacttaaaattttacttttaaatattcagatgcaccatatatcacaaaataaaattactgaaataaaaatccatatccaatgacaaaataaaaatgtgcctacctagaatgcatatatataattgattaaaaaagaacaacagaaatcaaaaagaattatttttatgacttccaaaaaatattttactcttgcttccacacattgcactttttaagaaagcagtctgaataaaaattgaattgaccagagtaaaatggcacttttatataaaagttaaggagaaatttacacaaaaaaatgaacgaacgcattcaagagatcggtgaatatagacttggacgtactctaggttccggaacaacaggaaaggtaaagctcgcagttcataaagatacaaacgcacaatatgccatcaaaattatcaaaaaatcaatgtttgcagtaaaacccgatcttgaacgtaaaatacacagagaaatagcacttatgcgattattagaacatccacatctcttaaaattatatgaagtatttgagtcacctcatcatctttatatcgttatagaatatgcttctaacagtgaactgtttgattatcttatccagcaaaaatttcttccacaagaagaagctatgatgtttttccgagaaataatatatggacttgattttcttcattcacatggaatttgtcatagagaccttaagccagagaatatccttcttgacgaaaacatgcatataaaaattgcagactttggttttgcaagatggatgagatcaaatattgcagaaacttcttgtggatcaccacattatgcagccccagaagtaatatacggacttccatatgatggtcgatgtgctgacatatggagttgtggcgtaattttatatgctctcttatcagtatgttttttatgcggatttccttccattgaattataatatgggattaggtcaagaatttttgctgttaagctgagatgtttgacgcaaacttggaagagattgttctcttgatttcaaagacaaaaatttgtcaatacaaaagtgcttaattcagtagaaagtaatcgtctactttcaaaaatcaacacttttgagataaagtgcagaaacatccacagttttaacgttcttcttacttggttccaattttttattcaataataggaaattcgcatttatattattaactaacacacagggtcgtttgccatttgatgatgaatcaattcgaagtctcatgaacaaaatcaaaagtggtcaatataagatgccaccctttcaacccgaagttcaagatttaatttcccgtatgctatgtgtagatgttaaatctcgtattaccatttcacaaatcaagtcacatccagcatttctaatgggtctacccaaaggatatcaagtaccaacaccattaccaaatccgacagtatccacaccaattgaacttacgccaaacgacttaccatttatgcatttattacgatccattggttataattccgatgatgagatcatcgaagaattaacctcaaatgagtacaccagtgcgaaaatgttctatcaaatgtataaccacaacactcttcttgattcattaccatggtatgatgaatcagatggaacaatgatagttggtccatccgaaatagaacaagcattaatgatgccgccgaggcaatttgcggccattggaaacatttacgatccattcgccaagaagaaagttcttgtcgaatcgattggtagtgtccatacaccacagtcatttgtccaaagacccgattgggacacaactgctcttcctaagatgtcgactgacattgaacaaatgttaattggcatccaattacctttggaagagttaatgctcttcttgcaaaagcaactgacatcgtgcagaatcaaatggttccactttagtgacacagaaatggtcgcgaaaaggctggaaacagacatgttgttaactctgacggcatcgtacgaatcgcccgaagttttgacattgtgtgtgctgttgctgcatggacagaaagaagagttcgaggtgctgataaagatgttggaaagaggactcaacgaggtgttgaacgaggctatgatttgattaaagaaataaatgtaaacaaaaagaagcatttgtcaacttgtgctcagtttagatgtgtttattagaactttttttgataaaaatgtgatttaattattgaaattgtgaagaaaaacaaattgtttcaaatagccaaggtacttttaggtattgtatctcgttcttttctctgtagtgcgaatcttaatgtttgaataaagattaataataatgataattttcaatatttttcttgtactttcctcaaataaattgcgcctctcttacaagatgtaattcgataaattattgaaggatgttttcaagaaatgactgtctggttccgaaacttcgcggttttcagacagtggaaattgtttcaaaattgtgaaaaaattttatatattcaaaaattgatacaattatccgatctttaattgcggtttgatcgggaaaatttttttcttaaatgtgaatcacatgtgatcccccagaaaataaatgacaatttgccggtaaaatttatcaaaaagttattcactcaaatcatttcacttttttatgtctctcttcgaaattcaatttagagcaaaagcatttcgaaattgtttcaatggaggaagtgtgggtcctgcaaacgatcatatcagggttcttagagaacaaatggataaatatcgtgatagtaataaaccaaattttgaagctgcagaatggaaattaggagaagaaacacttcgtttttatgaagaagttaaagatcttatggatttaatcgcaccattcaagtcatatacatcagtgatttcttttgttaaaagtgaaagattaggggaaaaaatgaaaaacgtcaaggaaaggtccataccaaacagttttcttcgcgactataaagggaggtgtgaaaatgctgttgaaaaatggaatccaaattttgtcaagcttacttctgctgacaattacaaagaaaccattgaagctcatgaaatctgcgaacaatttcttgaacattatgatgaatatgtaatgtatgatcaagttgaagattttgcacgtaacatcggatcaacacttgataagcaacttagagaacttgaagactggacaaaacgtaatgctcaagttcgaatcatggatacttgggcagatctcaaatcaacaatggagaaaatcaccagtcatcctcattctgacttacttcttgaaaagcctcgcatcaaagctcttttacccaaatacaagtcatttcatgaaacacttgaaggtggtgcaattgaagatatgcaagttaatcaagaagcccaaacaatggttcattggatctcagctcctttagataagtatcgcctatatgtcaaggcaaaacatagtgattgtgattcgttccgtgatgttgttgcagaacaaattgaaaacatccgtcaaaagaatccaaaagtgcttgaaaccccaacgatcaaaaccgtcattgaagaatttgagaaattaaaagaagaacaattcaacaatgatttaattatctggaagacaaataaaatatcatacttccaaaacaagatggaagaatttattcgtgaatatcgtgatgctcaatcaaattcagatacgtcatttctaattgatggaattcttagaaatggcgaagaattcatggaaaaatatggtggcagatcaaagatttattgggagaagtatccagatatatttttagatttcgcaaatgatccagatacaggatgtaaagaacttgttgatgaatggaatcaaatcattgactcacatagtggttatgttgatgaagttaacgaaagaaagagaagagagaaacttagtatagaagaagctgatgcaattagtgaccttaaaaaagctattgatgcatcagtcgatattcgttctgatattggattcccaagaatcgaaaatgcattaagatatgcaaaagagaaaaattatgaattagctagtgacgaacttgataacttaattaggaaatgtgaagatgaagttataccaattataagagatagaattagatacgtcgaaatggaaagagaaatgaatgacggattcaatagcattaatcaatatatttcgactggcaacataggcatggcacgtgatttgttggaaaaagtaagatatattgtcgatgacatttcattcttgaaaaacgaagaagctaaagacacttatgaaatggcttcaagtaaactccaagatcttgatgataggatcagtgaaataacgcatcaaagcgaagcacaagtgaatgaatcacttgaaaacttaaagtcctcaatcccatcaacaagttcaccttctccagaaccaacgccagcacctacaccagcaccaatgccaacatctactccagcaccagcacctgctccacaacctgcagcagctccaactccacagccagaaacacctcctcctgcagcatcgtcaccacaacaaccacagcaacaaattccagccgcttcagtacaagctgctggcgaatcatggaggccatgcaccgaattcacattgccaagagaagttatgaacagcttgagcaagcaagggcaatgggcagtcaatgagtggctgaaatatgtcaaaatcttcaacaacatggcaaaccaagttgatatattcattgattcgatatataataatcgtcttaaatctgaacttagtccaagtaatattgtacaatggaaacaaagcattgaaagcaacaggtattacttaccaaaagaaattcttccacgtatttcagatgaagaaacaaaagaaatcttaacaaaggcaggagtttatgatattatgattgaagagcttaagttaaaattcggccttagacttaatcaattattaagtgatgctcaagatctatatcaatatatgagcgatttcatggatcgtgataagtacacaaaacttattaaggtatttccaactgtcatcagtatattcacacaatatttaagaaacgttgaagatgtaattagatcatatgatatatttgacgtaccaccagtgcctcatcttgagtcagatatacgaaaaatggctacatccactcaacaaattctgaggcaagcaggttatagtaattctgtttatcgttatactgttgatgaaacttcaattaatggatttaatgcttataatttcgcttatgctcttgatcaagtattaagtaacattcgaaaagatacaagaaagttttcaatgtttccaaaaatgaagccttacttcgatgatctgcatcaaaaagttgaagagttacaaaagcaaatcttcaaagtttggttcgatgcatttgaaagatatgcgccacttaaaccagaacgtggtacattaaatagcttattatcatacactcgtttaatcaaaggtttcgaaccacaatatactgaacgtgcattagcattagagaaattaatcaaagaaaacgcagcagcaaataatgctaaaattgatcaattgattaaagaatggaatgaagcacgtgagaatgagcatcaagaaagagttaaagttgttatggatcaaatcattaaaccaattgcatcaggaggtaaagttacaattaatggaaaagaatttacttatgacttatctggtagaacaacaattatctttagagcagtttcaggacctgacttatataaggtcgaatttaaagatacagctgatgctaaatgtgagaaatggggattcttctgctcaagtaacgctgatgaaaatcattatgcaacacgtttatgtccactcggattttactccattttcatcgataagaagccattgatattggacagaccacaagattgggaaaaggatataatttaccaaagcgccgacttagtcaatgaagttaaagtcaatgtcgacgaagtgaattataataatgtacaagacccaagtggtaaacttaataaagtaattagggcattggtgtctttccatgaatcaaacagagataaaataatgagaatgtcggcaaacgctttggatgcaaaggaaaagcgtgaatacgaagaaagacaaaacgaacaaaggagacaagaacaacaaagattaatggacttcatcaagtatggaaccacattcaattagacatttaaatgtgtccataacttaataaaaagttgagttgattcaagaaaaataaaattctttgtgacttttaattgttattaaaaacataacaactataaattttaagagtttttacaattaaaatattatgaagctaaaaagatatttatattttgtataaaaagtctgcttgttaaatcgattttttgaaagcttatttttcattttattttcccgtataggacttgatcttgagtttaggacttattcagaacatctactaagggaaaaaaatcaataaatacgaactgattgctgtgatttcaaaattgaaatatatatgatcaactcatagaaagtttccgatagataattgaacactttacatatttgggaattgaattagaacgatgtgtgataggaataaacgtttcttagaggatggaatgtaaggttgcattgttttcacctaaagaaaaggcagtcatcgttaatttcgctttgactttcgatggttctgatgttataataaattttacaaaagttaatcaaaatttatttgcaaaatactcaatcttcgcttttaatacattttctgtaaatgaagacgacaaaaaatgcatactgcagacagattcttcgcgtttagtattctcatttaatgatgatacaagatgtttaaaatttatttcactcttatcagaaaaaggaatactttctccaataccaggtaaacaatgctcttttaatatttcaaggcctaaatcttttcccaatttatctggaatagttaacaatttatttaacataaaaaataattcagcaacacagccaaatggccttgaaactggtgtcatcgaggcttcccttccatttgctgaattagctcctttgaaaaaagaggataccatcaatgtcaaatactccactcttcattttgctcttcttaacatttcaatgaatctttatccagacattatagctggtatatttcctcctactaatactactcaaccttttgaagattatctcaaaattaagagtcaatggcaacttatcactaaatctgaatggcagcacaactgcaacatgcgtatttttgttcatgatcttgagcattggcttggtgttcgctcaaaacagcacaccgaagagtataaccgtcttttctttaacgtttctctgacacttttcttcagttgtttttgtgaactcaaattctctgaaatatttgccacttttcttgaaattctgtgctttactttcatccgaaagaagcaagacaaaactgctttctatgattccagtggtaaacttcttactagtgatgaagctgagaactgggtcttttggaggataaaaggtttgtggagaaaaataaccaatattcaaacatctgagttaaatgattcattagccattcgttctattcttcttaacatatcaccaccaacactagagatgcttaatgaaaggaacataacatcgttgagcttcgcgactcgaaattgcgtttatcaaatgtttgtaaaaggaagaccaaaacaagatgcactgcttctcgtgactgctgctttagcatcagaagatttggttaagtttagacagtacgcaattgctgttgcgttggttcttctacaaggaaaacttgaagatttgccaaatggagactttgaattgttttcacaaatgtatacaaccgaagtacaaaaaattaatccgagagtactgttgtataatgtggaaaaaatgtttgcttcatttagtgaataatttattagtaaatttgtttcatgtttaattaattaatttgttttcttcataacaataaaaaactgcgtatagtgctgtaataaaaaatccaatatgcgtaattttgtgttatcataaaaaatgtttttacgatttcaaaattttagaaaaaaaaaataatttcatgcataatcctttgagtttcatatgtataagtactgtaattggcaatttaaaaataaatatatataaaaagtgactatttgtaatgtattcaattctgatttagtaaatcgaatattgtttttctgctgggtatataatgggaagcacccaaagccagggaaaaggtccttcaaaatatagcgaaaatcttcaaacattaaaatgtattgaacaaataatttatgacttaaatgcaaataatgtcaatgaatcagtagaatcagcattaaaatatttcaatgaagaattattatattcatttaattttattatttgctcgattgtattttcatattttgtatcaaaaggtttttatcatttatgttttgactatttaaaagtacttgaaaaaaaagaaaaagagacttataaaattttacatgataatatcacaaatatttgtgcttttatatttttgaattcttcacaagaatcaaattatctttatgaaaaaatgattgaacatgatattattcatcctaaaattttggcaacaaaaagaagtccatatttcgcacattatctttcagaagaagaatataataaatttcatggctttaaaatttataattatttttatgaaaacattgatgaactaaaaaagaatgattgggaacttcataagaaattaattaaagagggacataatccgaatgaaattgcgaaaataattcgaaatgatgaaatcgaaaaacttcaagaaatatcatcacaaaataattttgattttaatcaaacaattgagccatcactttatgaaagatgctcatttgttaatcaagaaaatgtttcattaattgattatgcagcatttttttcatctattaaatgttttaaatatttacttatgaatggagcaaatgtaaataacacaggtaaatatgcagttgcaggtggaaatgaagaaattattcatttatgtgagcagaatcattcatcatttgaaggagcatatgaaacagcaattttgtttcatagaaatgatatctttaattatctttatgaaaacaaaatcgaaaaaattaggaatctagaagatttaggaattaaatgtcttttatatcaaaattatgagattttattatttcttgaaaatgaaggattacaggttaataaagctcttgtaattaaatctattgaaacagggaatacatttatggtacagtatttccatgaaaaaaatccaatttctataagtttttttgaaacttcaataatttttgttaataaagaactatttaactacttaattaaagaaaatattatgaatattttcgataagagtgattttataattaattgaatgtttgtttgagtgttaatatgcttttaaatttttggaaaatatccaaattatttcaaacagcacttatgtatgcatctgtaaaaggtcatatagatattgttaaactaattcttgaacaaaaaggaaatgatattaatgccaaagacatttatttattcaatttaatatttactttaataattttttcatatatcaaattaatatttggggtttaatcaaaacatttaatacagtactaatttgggcagctgaatttggtaaaatagaaatatttaacttacttcttaaacaagaagaaattgatatcaatactcaaaatatttgtgtcttttacttaaaatatgttttatgtactttatatttcataattatatttggaaattattttaaaaatttcaaacagctttaatgatgcagcatcaaatggttatatagaaatggttaaattacttcttgaacataaaggaattgatgttaatgctaaagatatttattcattttgtttaatatttattgtaataattttggatttcattctaataattggaaaatattcaaattgtttagaacatcacttatgtattcagttgaaaatggagatatagaatttgttaaattacttcttgcttataaaggaattgatgttaatgctaaaaatatttatttgtttgatttattatttattttaataaaattatgcttgaaaacattatttggaaattatttatactgtttcaaacagcactaatatgggcatctaaaaattgtcgatgtatagatgtaattaaattacttgttgaacatgaatgcattgaaatcgatcaagatatttatttgtttgaattaaagttagttaataacttacaatccaacaaaataatgatttaaatttattaaaaatagaagtgtagtatttcaggattcttaatactgtttttcataaattatgagaaggaaaattttcattttttcataaaaatttatcccaagggaaattgcgatcacattcgtaaaaatcaaattacaaccaaaaagtacagtcaccaaaacatcaaagacgatgtataacaataataaccttgttgttccaaattttttttaggaaaccaaaaacaacaaaaacgataacatatgttatcggtactaacggttgtcgtttagttcaatgtgacatatgatttttgagaatttttttttgacacaccttttttcattgaaatcagaacattaggcggttatggtctttccttttatataatgggtgctggcactccatcattcggtaaacgtcataacaaatcacacacaatatgccgtcgttgcggaagccgttcatatcacattcagaagggaaggtgcgctaagtgcggatatccagaagcatcaatgcgtcattacaattgggccaagaaagcacatgcaaagcgcacacaaggaactggccgcatgagccacctcaagaagtgcatgaagaaactccaagcaatctatgctcctaagaaataaacatatttttgagcaaatcatttatgcaatgcttttttttgttaagacgacaacatttacagtttgattaattttgtttattttaataaaaacaagtaacaacgcatcagtaattacaataattattactagcactttcattagttttaatcaattgatttgaaatattaaaaatgctgctgaaaatggtgattgatctttgtggttcataattgatgtatttaaaaaacctaattttgtagttttttaccaatttggagtacccctaatttaatcggcgagggatggtaccattttttaaaaaatttgacaaattattaatttggatccaaattattagttattacaaacccaattatgctcattgataagagtacattttaattatgttcaatgttatttgaattttaatatgaaacattaaaatgccaaatatagttacctcaattaaaaaattctcatttcaaaattgtggtaatttcacattgtgcttatatcatatgttgtggatccacattcataaactttatcatattccataattgcttataatttctcactaattagttatcacacgtacataatcttaataaaataaaaataaactgatcctaaggtcttgaattaaatttcaatacttatttttttctccaattaatttttcatttttgaatgataatatctcaaaattaatagacttttgcatgcatttaagattcatcatcaactctttatttagaagtttcacatgatcaaattaatcgtttcatagctctgatgcacattaacaaatgaactgcagtggagcaattggaaaaaaccgaaaacacgattgtaatatattcaatttctcacttcgacaggaaaaaaatgccaggataatgatatcgaaaaaaaatgccaggggaagccagtactggaaaacaaagataagacgcatagcaacaaaatataaaattttatattacaaggcacaatctccatgtaaattggtaatctataataaaaatcattaatttctcaagaaaattattttatttcagtaataattctaatttacgacaaaataatttgttgccaatatggcatttatttttatttcgatttaagcatgcagtcttacaatgacacaccgtttcaattaaaaagggatcacccaaaaaggcaacatttatgtacaggtgctctcaaggatgaaagagggaaatacaccattgaatatcgacctgacttcgctttattccatgaagcaataatggaagcaaaaggcaagcccacgatttttgttacatttttcggatcatatcaaacagggaaatcgtcagcaatcaaaatgctcacaggtgatggggaagtacaaattgatattggtgacggaatgcgagaaacaacttatggtgcttttgtgtatggcccatattcatacaacaaaatccggcaaagatttggagttgagattattccagaagatgacacacaaatattttttgttgataccgaaggatgtaatggttttaaagcaggtagacctgaatcagctgtttatctcttgagtcaactcattgcaccatatgcatcaatatcaaacgtcgttatatcaactattaaagcaggagttacagcacccgaagttgattcgatggaaacaatgtttgaaattattaatattattcgccaaggtgttggtgtggaaagtgcacatttgttaggacttgttccaaatgtcaccaattattttcccgaaaattttgtggaaaaacaaaaacaaattacagaaacaatgcaagagaaattcgatgacttccaattcggatcatttaaatttgatgaatttattccacttcctatatttgacacagatcatgacattttagaacagaatgaaaggtttaacaatgcattttgtatatttgcacaacgacttatatatcatattgacacttctcgtcaaagtatgttacttgaagctgaaggaatatttgaaatgttcaaggttttagcagcgagaactgaagaacaaaaacttagtgaagttgcatatgaagcattgaaagaaacaaaaaagagttctgcatggaaactttccaagagaactgttgataaaattatttctggaaaaaatgaggaaatcaagaaaattgttgcagaattcaaagaaaaacttaaaaatgatcaaatatttgcaactccaatattagataaagataaaatcattaatgaagctctccaagaacttgatgagaaattacccgagtctacgaaatcagagaaagaagtatatgatgagtttaagtcaagaatccaaagagaaatttcaactgaatataagaaattcggtcgacttattaaaaaaattaaagctaaacaatacacattcattaaagataaaatagctacatatataaataatgcaaaacctgtcatctatactaatattcgaaacaataagtcaacatatgaagatcacatcttgaacatagttcaaaacgaagcatttacatttattaaaaatcaattcttaagagagagtaatgaaatatgtaaagatgttcaacaaagaaatgctgatattgtagatgatttaattgcaatatttgaaccattaaaacttgaagaagatatcaaaacaaaagttaaagaacatattatgaaaattaagtcacaaattcgaaatgatttttttcttcaagttaaagcaatagttgaaaacaacaaacaatcacaaatcagagaatttagtaattatgcgctaaattttattaattcgaaaacaagtaacttaagaagtaagttggaaaatggaaatcttgaagtagcagaaataaatattcatagtgattttagacaaattgaaaatgaatgcaagaggtcacttttacgaatgtacacagataacactaatcaagaaattattggccaagtcgaagcaaacattagtacatatctaatgaaatcattaaataatttcaaagaatgtattcaagaagctaaaagagtcgaaatgcaaaaacaacttctcaaacaaactttggctaaaacaatgtccaatcgaataaatgaattaaagcaaaaagttaaatcaagttcagcaacagatccgaatgatattattcctaagaattcatttgaaaacatagagaaagaatgttatcaagaaatcaataaagcatttcctgatggaaaagagaacaaagaacttatgaaatatttaaataatgaaataatttcaaagaataaaaatgaaatggaagcaattgagaatttaaagcaaacaactgtccaacaaaacattaaaaatattgttaataatctccaaaacaaagccaaatatttggttgatcatatatattatgaacttacatcatcatgtagaaatgataaaaattgcgttgatataacttgtataaagtttaataataagtttacaggttcaattgaaacatttaactttgaaacaactgataataaatttaaagattatatcataagaagatggaacagaaagattaataaagtttcaattcctaacgaaagtaaggcatcagttaatagttatttcaaggattatcttaaaagaaaactaaatgaagcacaagatacaattaaaaacataatttccataaatgaatacaatataattaaaaagaataaaattgaaattgatgaagaaatggaacaaataaaacgacaatgtacttcaataatttgtaacagtgattcagcagatgcttcagaaattgtcaatggatttagcaatgaatttaaacgcgaatgcaataatattaaagaaaaaattaattccattccaagcgaaaatataaagaatcagttaaatgattatttggctggtcaaattcaaaaatgttcgaatcagctaatgaaagaagctgaagaaaaagctaaaaacgcaagctggtggagaaaggctgtcaatattttaggaaaaatttgggataaaataaaaggattcttcgggttttaagtcaataatcactaaaaaccaaatgaaatttttgattttttttaaaaaagacatcgtttgtgttatcagtaaagaaattttaaattgtaaaattattgtgaaaaatgggattatcatttaaagcaattgaaatcttttttgtttcagtaagaaggatatacatcttattcctgtgctagttacgaaaaattgataataagaaattgtttacttattaaattggaggcaataaaaaatgacaaatcatttaaaaaaaaactttatgagttttattattgcaataatgaagcaaactccatcatggagtgcgaagataaacagttacaatgtcaaaagccatttttcaacagctgttaataaaataaagttttgcaaatataaaagtggcattttcaattgatctgcgatataacatctttaaggttatctgaaaatgcagcaagcattgcaatttcattaaagcactcatttaacatatattccacgcagcctcttcaaaggaggtatctaaaagattttgttaattacaaaataacaaatgtttcgccactttcagatgggactacagttgccttttctacaactcaaatttctggtggccttgatcaaaaggtctatatttgcaataatcaatttggggaaaatacccaaataaaagcgctaaatttcaatgaagaaattctttcactatatcttacatcacgttatcttttgacaatacagcatagttctgtcttaatatatgacattgaaaatcgaattgttgttcttgatcaatcgacttacaataatcccaatggagctggcgacattgttactcaaggtgacaattacaccgttgccatctgtggctctgatccatgcactgtttacatttcggagcttacaaataattcaacgccaataattttcaaagcacatgaacatccaatattttccatgaaattttcaccagatggttctcttatatccacggtaagtgagaaagggactttgattcgtatatttgatacaatttgtggaacacaattaagtgtttttcgtagaggatctatgccatccaaagtcatgtcaatgtgtttttcacccgataatcgttcacttgttgttgttagcgaaagtggaactgttcatttatttgaagcagatgtacgaaatggttcacaacaagatcctccgcgtgcagtggcaaagctaaaaatagaaaaagcggatatgattgattccgcttttataagtgatacagaaatgataattgttgcatcatctggctatatgtacaatttggaaataagagaaaaaaccatcaaacaaaaaaacagagtttttattttattacattaaatgtttttttttttttcaaaaagctcttctgttaagaaaagcaaattataaataaaatgaccaaaaattagttaaatttaataaaatttttgtaaaacaaaatatttttttatataactcaaaaataacagacaatgttcagaagatacttcttaaaatgaaaataaaataagttaaaacaacataaaatgttgtatttgatcaggtgaagtgagatttatcgtaaattcataactcatgtaaaattctgattttccactttttcggaggagaaaaggccttttcctgaatacaacaagtttacaacccaataaatttcaattcaaaaaagcgtaacatttgtaaagttagcacttttttacctgcgcttgtagcataaacttatcaaaaattgaatgggcattttattcattccgatggcgttgaatgctttgatcacacgacgaacaatacgtcagtaccaaccagactacataattccggaagctgaattgaaagcaatttgtaatgcagcaattctttcaccaacaggatttgattcacaagatattgatcttcttgctgttactgatagaaaaaaaatagacgaaatttccaaaataacattggacacaattggtaaagagggtcgcgatagttttatgaagagggttgattcaatgaagattaaaaatcctgttacaggtgatgcaggatgtctaatttgtcttttgaagaatgagcgatcctctcctatgcatacaccagttcatgaaggtattgttgaaatgtcaataatgatagctgctcgcgaatttggcttgcaatcaatggttcttggctgtctcaaaggcgctgacatgagagcaatggaaaaagttcttggcattgaatcaggccgcttacttgttggcgttgttattggtaaaccaatcgacaaacctgtcttcattccaaagaagcttaaagctaaaatttcatatctaagctaaacatcaaatcatgatttaatttttatgatagaagtgaatttaataacttgccccattgatctggtgcaacatattaatgaaaaataaaacgatcaaatatatgttcaaaaagttataaatgaccataaggaacgattaatattggttgaaaatgttaaaataatcaaaataaccatcgatcaaaataaattcaaaaatcgggtatttggcaaaatataaagtgagtaaaattttggcatatttatttatccattaatggagaattacgaaattaccaaaacattaggaaatgggggtaatggcaccgtctatcttgcaaagcataaaggtactatttgcgcaattaaaaaaattgacgcatcaccagagcttctaaacatgctcaagaaagaacccaatatcctaagaattttaaatcacccatttattattaagtatattgattgttttgaaaaaaaagataacattggattaactacaatttggattgtaatggagtatgcagatggaggggatttagctgaaaaaataaaaagcttcaaggaatcaaaaaagataatgtcagaagatagcattttggattattttgtccaaatagcacttgcaattaaatatcttcatgacagaaaaattattcatcgtgacctaaaacccaagaacatttttttaactaaggataatactattaagttaggagattttgggatcgttcaaattcttgaaaatacaaatcaattatgtcaaacatttgccggcactattaattatatgtcaccagaaattgtcagcaaagggagctatagttttaagaccgatatatggtcacttggttgcattctttatgaaatgtgcacattacaatctgtgtttccatcggagtccccaagaatttttgatcgaatcaatgaaggcaaatatgttccaattccaccagatcgatatagcccagaaatatatgatcttgttaaaaaaatgctttcggtagatccaacccaacgaccaacgatttatgatatactttcgaaaccatttatccaacaaagaattcattcccttctcaagcgaggcattattgacccagaatttttgaaatcggaaatggaccatacaattttccatgggtttacacctatgctagaccctccaaatgataaatttcatatgaggattttatttgttggatatcattgcgtaggtaaaacggcattaatcgaacgtttcatctctggtgagtttaatgctaaaacattagcgacaattgcaccgacatattatcgaaagaaaatgaaagttgattcatatttattcgattttgaagtttgtgatacatcttcacaaaatacttatccgaactttaaaaatatgcaaattaatggcgtaaatgcttatgttataattttctctgtttgtgatcgaggttcatttaatgatatcaaaaaatgttatcaagaaataattgaaatggataaaaacgcaatagttttcttatgcggtaatcaatgcgatcttaaggagaaaagaacaatttcaatcaatgaaggaaaaaatttggcaaaagctcttaacattgaacatgaatacttcgaaacaagtgcattgactggggaaaaagttgacactatgttcgacgcaattgcaaggaaatatttaatgcaactgaagaaaaattatgatatgaaagaagaagaaccttcattatgcacagtatattaatcgaatggacgttataataaaaaaaatttaaaaaaaattaatttaattttaaaaatagacgttaacagattacaatgattttagtctatttttacaaaatcttgttggaactccacaagaataaaataaggattcgcataaaaaaaaatacataaaatcataagatatttgatactttttatgcatatatatgacatcaagttaaacttaataggaaaaattacaatgaatttattctttacttaagaagttcttctgggatagaatcatatgttaagctgtctggattgactggtggcgtgccatatgtttggataaggattgctacgttcaaaacgccgcccttcttgaatccagagagtggcgttgttctgtaccatccgattaatggtcttccgatttggaggtcctttagtgggagcttgagttcagcgaaaactttatcgaatttaggattcttgtctgcaagtctcaacacaaggacatcctttgattgatctgttaagtaaagattgaaactttcgaaccattgaggtgattgtgtatctcccttagttcttgtagtttgataccttatatcattttcaagttgtattctgcaatatgtatcattctttgataatttatctacacgtggacagttaacggcctccacaacgataacttgtaaacttaacggttcgaacggttgtggcacaaacggtttctgcattgggaatgtcaaatgcgaaataatgtgaatttcacccttgttacctgagaattgatatctttcatcagaaacggctccgaatttgatgttaattaatggtatcattgctttagcaacattcttatcttctttatcaggtacatgttccattaattggatcttcacttcatcggtattcaaactgataacgttcaacgacatcatatcgttaaattgaccgtttgaggcaattcttgtcatgaatttctttgaattcttttgttttctgagttttacaatgcaatatgacattctattgttctccattataattcttgatccttcaagtatatgtaaatgaacttgcatttctggtgcttctgtaggcattaatggtatagcattaaatgcttgagctccaacagtagtaatttgatattgtaatttaacagaaccataaacaccaaaactaacatcattatcataaacattattaaattccattccatttaagtcgattaaaatcggctctgtaacttttgtatctttctttttcattgaatgattcattaaacataattgtaatttgttttcgattggtgccattaagaagtggaagtcatcagctatttgatttctaattgaagaacattgtggaattatgtctcctttaacttgcatcattatataaggctcgtcaagttctttaattggttgttgtgtaattgctctaacattaagcataagaggaacaaatggatcattaacaaatgacatctttcctggcgctgccaaatgtgtaataagatgaatttgacctgctttagagaatcctttagcaggagttaatatataagttttatcttctggtacaccacatgctaaaatattaattggtaattcgatataaccaattaaatcatctttagaagctgtgtcatgatcataaacagatattttaactgaatctgttgcatatccattgatttcgatattaaagtattgattccatttaggattctttgagttatcaattgttcgtgtcttgaatttcttacctgataatgtttcgattgtacaatatgcatctgatgcattaccacctgaatctttacttgcaatattaattccttcgataactttaatgtataatgttaaattaggattcatcatttggataacttcttctctaaagtctaagaatggttctgttccatatggtactacttgtaaacgaatattaattttatctttgttattatccattgtataccaatcagaataagttttaccaatttggaattcactaagtttaaagcttttctctgatataagtcgtgttgtaggtggtgcataatctctaagttctaatgttaataaatctaattgtggatcatttaataaaacagtaaatgtttcataccattgtggtgctgaagtatctgataaatatcgtgttttaacagatgttaatgtaataccatttaatttagcatgaactaatggatcatatttagacactacatctgatgcacgtttctctaaaatagcttcattaatcttaagatgtaattgatataattgtaatggatgtggtacaaatggtaccattcctggtcctgttatatgagatctaatatgaactttaccttgtttaagattataccatttatcttcgatttgtccattagataatgatttggttggtattataatttcaccaattttttcatcttttgtaacaacatcataatctcgaattgtgatcttagcaacatcatcatcaagacattgaattgggatatgtgaaacataattccattgtggatttaatgttttacgtattactggtgaataaagtttagtgttcttacgatgtctaagtttaatttcacaatatggatcagatgaacgatttacatcacagactggtaaattaacagcttcgattaaatgcaaatgtaacattaatttctcaaatacttgtggtggtggtggttgtccaaattgataatcaataaatgcttcttgacccatatttaatatttgaccgaaacatttaactttatcattagataaatcagtgatttgaccaaattgcattttatcgattggaataattgtatcgaatactttcttaggctctttcttttcttttaatggacgagggatttcataagcagttaataaaagtttatcctttgaagtatctgtaaggaaaatcgggaagttctcttcccaaatttgtattggttgattaattgtagaaacaccataaatatctttcttaagttgtacatggaagaacatatcgttttctgtttctttaggatctaccatacttgataaatggaaatgtaacattaatggtttgaataatttctcaataaatggtgtttcatttgctgctgttaattgatatctaatttgaacttcgcctcttttatctgcatgaccaggtttataatgatataagtcgacccatttagaataaactttaccaaattctaatgactttaatgggattaaacattcggaattatatttactctttttagttatatttaattcatataaccttaaagcaaatgtatctgtattaagacttcgaggcttaaacttaaagtattgattgaaatatggatgattatcaccattgataactcttgacttttgttttgtcttttgatgatgtccaatgaattccatcttaaataatgaactaacataagatgaattaacttgaggatctaatactttagcatcaattaaatgaacattaaacataagttgaggttcaggtggtaaatatttaatctttaatggtgcattgaatgacttcttaccaactgtatcaatatgaatcttcaaatgcatttttcctttagtagtaccatcttttcttattaaatcaaagtaatcatcataaacaaaatctggttcaaattgtgaaagtggtacttcacattgagaatataatttattacctacttcattacaataaatttgtgtaactaaaatatcttctctttcattattaagagtaaatctattaacaagttcaattttaggtgtatctgttgaatctaatttccttgaagaagatttagcaatatctcctttaaggaaacatttgaatgatacctttggaaggagtttatcagcaatatcataagcatcatgtgcatttacagatacataatgtactttaaattgttgactcaaaaatgctggttgattaaaatcagtaatttgtgaaataatatgtaattctcctcctcctttaacactcttccattcatctttaactacaccgaagcccatttcagtagctttataatagaaagtagaaagtttatcatcttttgtaactttatcatgatcataaatatcaatttcaaagatatctgtattaatgctttgaactgggatatggaatacttgattaaatattggattagatgcattaggaataacacgtgtcattccgagatatctcttattcttattaattttctttcctttgattccagacttcattgtattaagtgggaatactttacaataagcatcagtatatttcttcttattaacatcttcaattggtaaattacgtgcttctttaatgtaaaagtgtgcatatctttgtgttgaattaacaaatggtacaactgttggtaaattaaatgtaaacttagtattaattggtaatatattaactaatactttaactttagcattgatttctcctgttaaatcaatttctttttctaatggttgacctggttggaattcacataatgaaacataacctgttgatacttgtttagccattataactttttcattcttataatgttcatttaatactattttaattttatctaatcttggatcaactaatacgaatttagattcgaagttaaatacacctgattcacctacatttgatgtaattggtttgttatcatattcatgagaaatttcacaataatattctccttgttttgaaatagatgtaatatgtgataatctgaaatgtgcttcaaatggtataaacggattttgtacatatggaacatcaccagtattagctaaatgatataatatatgtaatcttccacctttatgacctttaaatggttgcatatcaatccaacggtcatttactataccaggttcaatagttcgtaataatatattagtagaagatattggatcatctttcgacattttatctttatccattattgtaatcttaaattcatcagaattcaaacttaaaactttaaatcgaaagtcttgattccatcttggattaattgtattatcaataatacgagtcttttgtattgtatctttcttaccaataaattccataatacaataagcatcactaccagtagcatctaatgcaggaatatctttagcttctaatactttaacatataattccattgattgacatggaggtggtgcaggtttaggtataggaactccagtaaatggttgaactgcttgatcatcaatatgaacaattaatcgaatcttacctccattcttatacgatttctctggtactaaatcataccattcatcatatacataaccaaattgaaaattagataaaggtaattctaatgaagcaaatgttacatctttaacactaccttcatctttcattaataatttaaatgaatctctcatatcagtaattaataacttataattagcaaaccattgtggtgttaaagtattatctaagacattagttttaactggagtaatatcattagataaattaaataagcaatatggatctgttttgctgacatctgtcttaggaatatccatagcttcagcaatacaaacattcattacatatggcttaaatggattatcaacaaatttaggtgtattaggtgcagccaaatgtacaactaaatgaaccatagcttgtgaacctctaatattcatcttaagtggataatatttatcttctggtgttccagaaggtaaactcttaataggtaattcaagtttaccaattttatcatctttaccaaatttatcatgatcatataagttcaaaacaaatacatcagtagaataactcttaattataaattcgaattcttgattccaatttggagttaaagtcttatatttaatctcagtcttcttttcattctttctcttcttaagcttaattttacaatatggatcacacattccactattatccattcctggtaaacctttagcatccaataatttaacatataatgtcatttgatcattaacaggtggtggtaaaccaatatcagagaatggcattaagtttggtgcatttaattgtgcatagaatattaaacttcctttgttagataaagtaataacttgagaaattgtttgtccatattgaagtgattttaatgggaattctccagtaccaataactgaaagcttattattataagcattcttatgttcaaatactaaaacatcttctttaggatcagtaactaagaaatggaaatcttgattaaacttagcattaagagttttatctttaattgaactattttgtgaatttgtatcattcttaagtttcattgagaacattgaatcaacattcttatctttacatgtagcatctttaacttcaacaagacgaacatttaattgataaggcataaatggttgatcagtataaggtacttgaccaggtgcagtaatttgatatttcatttcaagagtacctcctgtactatgaccatgtaatggagttaaatcaaaattaccatattgtgtaatacctggtgtaattgaagctaatggaatatctatgaatgaaattcgatcatctttaccagctttatcataatcataaagttctacacgtaatacatctgatccataactaattacattcattctaagtttttcatcccacttaggattaagtgtattatcaattctacgacttaatacgaaattcttttctcttcctacaaatgagactttacaatatggatctgctttaccattagcatctactgatgggatattagttgcacgaattaaatgtacttgaatttctagtttatcgcctggtggtaatggtggaggtggtacttcaatacctttccaaggaggtgctccataaggtgctacatgaactttcaaatgaatttgtcctcctttcttaacacctttagaaggtgtaatattaaaccatttatcataaatataaccaactttaaattctgttaatggaactaaaagtgtacccatatcatcatcttttaatttatcatgatcacgcattaaaatctttaaataatctttttgatatgatgtaataagcattgaatacatttcttcccaagttggagataatgtattatcctttgttttagtcttaattgggacttcatcatcattagtactaattaaacaatatggatcacttgctgaaccaatatccatagctggtaaatctttagcatctgatacaaagagatttaagacataaggaacaaatggattttgttgaaatgctacttgacctgcatcagcaagatgaatcattaaatgtacaagtcctccttttttaacacctttatacggatggaaattaaaccattgctctgttacaattccaggttgtaaagttgcaacaggtaaatctaaataaccaattttatcatctttaccaatatcatcatgatcaattaaagatatttttatagtatctgtacgaatacttttaatttctaaatggaaatcttgataccaaacaggatttaatgtcttcttaatagtcctagttttaagtggtttttgtttcggacgatttaagaacttaattttacaatatggatcacttttaccatttgtatccatggctggtatatcagtagcttcaataattctaatatttaatgttactttatcacttacttgttcaattggttgtaaacgtggtaaacctgggaatggttgctttccaaattccattatattaaatgtcatattaattttagatttagtctttggtaaatcaatacatttctcaacattagaaccaactgggaaatcagttggaattaaaattgatgaaacttctttttcattcttcttaagtgaaaacaatgatactttaaatttaagtccttgttgagtcattgggaaatggaattcttcattccatttgttttcagatctaacacaagtcgcttgaaatgcagaatcattttcaaattgtaatctaaagtatgattcttcaccaacacttttaccatctttaacacgaacatgtaaaactggataagtatataaactttcgacaaatggttgatcttgttttcttgcaagatgtaacataacatttaatttaccgttcatttgacttgaagaaccgacaatacaaaattcgaattctcttgattgacctggaattaaagttctaattggaacttcaacaaatccaattttatcatctcgtgatccaatatcatgatctttaacaacaattgataaaatatctgatgataaactcaaaacatttaatgcaaagaattcattccaaaatggatataaatcactttctacaactgttgttcttttttcacctttttgtcctttgattgataaaatacaatatgcatcacaataaccatttgtatccattggtggtaaatcaacagcattcattataccaacataaagtgtataacctttatcaaatggctttaattgttcttgtggcttttgtgaacctgctttttgattctttggcttcctcttatacatataatatttagatggatgaagtggattaaatgtcattcctgtaaatggttgttgtccaaatggaagtgcttgaaggaaaatatgaacttttcctgcataatctaatcctttagctggcgtcatatcgatccaatattcttttggtaatccatcaactaatggttgtaagttaagttctgttgtcccaattaatttctctgttgcaacatctttatcaagtaattcaatttgaagtttctcctttgctaaatcaaagccaatgaaagtcattcgttcattccaaaatggccaaaatgtgttttcaataacagatgtcttttgccaacgatgactatgatttaattttaatttacaaaaaggatctgactttccgaatgtatccattttttcaatatcagcaccttcaacaacttgcgcaaataagttaaacatagaaaatggtgaatgtgtaaatggaattgctcctggatatgtgatatgataaataacacgaattgaacccgtttctttcccatctttcttaattggaatccaaccatccataacttgtccatatcccatagatgttgcgattaaacttgcctttcctattaaatcatcttttcctaatgcatcatgatcataaacatcaaatacaaattgtgattcacctatgttttggatgtcaaatacaaataattgatcccatcgtggatcattgcaatgtggcttaactcgagttttttgcttgttgctttcgtttgaacgatcataaataacacaatatgggtcagacgtacctgaaatgtcaagtcccttcagaccacggccagaaataacacgaatgtatgcctgaagacatggtgcaggtggaagtggatcatattgttcaccagtgaatggtactgtttgtggtgttgtgaaatgaattgcaagacgtattttgccaactttactacctttggatgttacaagatcaaaccatgttttggtaacttggttaaattgaatatcttttaactttataagagtttgtggagaatcactaactccatttaatgtaagtgataattctgagtttaatgtgtttgtaacaaaacaaaactcttcttcccaaaccactttgtttgaaggcttaacagatgacgttttttgggtgcctttgttgccggctgaaagagtacaaaaaagtttagaggatggcttttggtcaagagttgcttcaatgacacgaacgtatgacaggtatacattaaatagtctaggaacaaaaggttgatcaacttcttctgcaagatgtgtaataatgtgaatctttggaactttggatgtaaccattgtcttgcagagatcataccactgttctaacacttgaccaggtgtcaaaaatttgggtgcaatttgtagatatccaattttatcatccctgccaactttgtcatgatcgaacaaatctatgatcagaagatctgtttcgaaattattgatatagaaatggaaatcatttctccattttggagttaatgaattttcgatagttcttgtttttcccttttgatcccccatccttagagcacagtatccatcacatgtcgtaactgcgtctacaacaggaagatcttttgcctcaattatctttacatggagcagcatgctgctaaatgacctgacaacaaccgccccaacgtgctttcaaagtgaaaaaattcaaagtcaatttttgaacaatacattcaaaaatactgactttttcagtataattttttcagagaaagtagtcaaacaagaaaaatcggctatcaaaaagccaggtttataacgggcgtaaaatcaaacgaccaaaataaatcatcttggctatcaatttcatattatcatattaaaaactatcctatatgaaattttattcatgagccttcacaaaaacaataaatttctcttaataactttgatttgcttattcgcaatatgaagccaattaaagacatcaagaaatatggtaaaaatcgactcattatcaaatgtattttttttagaaagtagttaaccaaaaacatttcaagtttctctaataaaaatatttatttaaaacaattgtttgagaattactcttcaaaaggcagcactttaatttgatctggatacaaataatcatctgaaaagtcataattttcttcgtttaccagcaaatcatcaggtgtcagtatgacttcttcactttcattatcgttttcatcatcagaaatttcatcgaattcgtcttctctttcataataaacttcattaaaccgcattaacttatcttcgggaacactttccatcattctaaagcgaattgaagttgcccatttgtaaatcgaatctttacatcttgcgaaaacgacaggttgcaaaggatggaacattaaatgaaatataggctgatttaatccatgaaaaacgtttgttataattcccgtaaaaacgttataagcaacaaatgactgtggtgtatatattcttgatgcaagtaaaacatgttcatcatttcgatcaaatgctgctgtcgaatattttatgttattaactctgtctgaaaacgtaaaacaaattataccagtctctgtgtttaaaagtcgacctgttccagatttatctagaataataagaaacttatcgttgtgtgacagaccgatagaggttatcgtacggcacttttcatcggtgggttcgaacgattgaatttcattgaaaccttttggattgaatactttgatgtttaggtataatgttgaagagaagaaaagaactgatttgtttgtccatgttgcagatgtaaagtcccctggaacttgtaccaaacttgaattttgctggtcatataaatataaagaattattatcaagaagaattaatattaagggtaatgctttaggactgtattgaatatatgttattgggtgatcaaacttgtattgatatacgatcgtttttgtgatgatagaatgtacgataaaatctccatttttatcaccagatgcaataaattgtgtatctctggaaaatgagagagaagttacctccttagagtgtaccttaaaatacctcttgttgtcaaaagatctggaatcacaaacaagtattttcccagtataataaccaatcccaaaaatattcccatggaagctcaaacacgatgatgttacgcgcttattaaattggtgtactatttctgcggagcgatcaggaagatctgtgaacttatcatcaaggagtgacttgagcgccattatttcatatagtatgtccgcaaaagtgtcatgagagcgtttaggatgtaaacatttcaaaatctgcaaaatcatttttatgaatcattggtaactgattattagtgagaatagcaatataaaaatgatcatatttgattagataataatgtgaatatgttcaatgcataatataagcatttttttgtttgtaagcgcagaacgttctttaaccaccaacaacgctgtttctgaccatattcaatttatgctttttgagaacttaaaatgcgatcattccattcaatttgaatgataatggaataaccgttaaatcgtgtggcaaaaattattggtaaaagttcatttgatacatcattaaaatcatgtcaagccttaaattttttagatttttttatatatattaattagtggtcgaattgttatttgaacgtatctataaatactttaattttccactaaattataagcaatttttaatctatacccaactttaactcatttgaaacatgctccatcgtatatcactttttgatgttattgagaaggtaaatgatttcctcttcatacacaaaatattatatgaatattcacaatttcatgatttgactgagttttaacacggctgttttattgttttcaatcatccacaattgaataccaacgcctccttttctttgaaaaccttctttttttctgtggtttacattacaacaaactttattgagccattcaccaattcaaactttgagccgaaaaaaacgttaaatcttaaaatcccaaactgtatatgtccaacgattccatcccgaaagccattcggcaataccaaatgcaagaaatattgggaaagggctcgttttcggtcgtttgcaaagttctaaacgtcttaaatcagaaacaatatgcttgcaagatattttcaagagatagaattacagagaaaagtgatctagacagattccagcgtgagattaatgcaatggcattcattcgtcatgaaaacatagttacattacatgattttttctgggacgaccacaatttttatttaattatggatctttgtcctggcggcgaactttatcaatatatggtcacccacggaaaattttctgaacctgatgcagctcttatattccgacaatttgcatctgccattgcatgttgtcatgcatatggagttgcacacagagatctcaaaccagagaacatccttatcgatgtctttccacgggttaaagtgagtgactttggtttatgcggctatatagccaaagaaatcaatatgcaaaccttttgtggttcaccatgttattgtagtcctgagtgtctttgtaaagtttcatatgatggccgactcgcagatgtgtggagtcttggtgtcattttatatacaatggttactggaaataatccatggaacatatcaaacacatcgattatgatccatcagatccttaaaggttcatatactatccctcgttacgtctcagagcagtgctcaaacctcatcaaaatgatgctgcaggttaacccccaaaaccgttttacgatggcgcaagttttggagcacccctggatccgacttggtgatcaatcagaatatgcagcccaggagcatccacccgaatctcctggtagtagtgaatgttgcactgaaccaattccactttcaattatctcacagctttcgaagaaacaaagtcaagtttcacatgacggaatattttcaccatttgaagatgaaggaattggaaacaatgaaataccaaagttggcagtaccgaagttatgcttaaaggatgggacacttgggaaagttcgatcggaaaatatgcaaagaagagttgtcatacaaaacccaaaaaaaagaagcacaagaagtacacagtcaagacaaaacgttgtgcaattgctgatgccaaagggatatgtggcgccaaggaaaaatagtttgccaaaaatattacatacgttcgcatagaattagaaatttttgttttgtaaataaacgtagaatgaaacggaaattgaactcacttgtgatcgatgttttatatggaagataaacataaaatgtgaatgatcaccaatttggataaacataaaatgtgaatgatcaccaatttggataaacataaaatgtgaatgatcaccaatttggataaacataaaatgtgaatgatcaccaatttggataaacataaaatgtgaatgatcaccaatttggataaacataaaatgtgattgatcaccatttggataaacataaaatgtgaatgatcaccaatttggataaacataaaatgtgaatgatcaccaatttggataaacattaaatgtgattgatcaccatttggataaacataaaatgtgaatgatcaccaatttggataaacataaaatgtgaatgatcaccaatttggataaacataaaatgtgaatgatcaccaatttggataaacataaaaatgtgattgatcaccaatttggataaacataaaatgtgatctaattgtgtcgatagtatattatatgttgattgtttgtggaaatgctgctcgctttcacatatatggatatacagaatagaaaaagcatgtcaaattttatgttaatgatgaatcattgaaaataaattacttaataatagagtttttggtgaataggtaacaaattcatgatgaatgttaaaatctttttgataaatcaaaaagacattttaaaatgctattgttttgccaagtaaaaaaattcattatgtaatttttgtaaacaaaattttttactcattaaatatcattaaaaaaaagaaaaaataatgatacaattttaaatgggcagatattgttgtattggttctcttatttatttattttcacatgaatttttttaaactttaaaaatattttcatgtataaaatttgttcaatcgaagatttattgaatcacacaaatttctttttgtggtttagtatcactaacattagtactattaaacattaggttggtaagaatttcgtagcctttgttgaatatgctatcaatggtgtcgggatttgtggctgtgcattccatataatcaattgcgccaattttttccgctaaagcccttccttgttcttgagtaattggcttctgtccatttcctgcaagttcattaagggtatgttcatctttgcgaagatctgttttggtaccaacaaggataattattggattattatcctcctctataagttcaggaaaccaaatattttctacatttgcaaaagaagtttggtcaacaacactaaaacaaatgaagcgaactgtatttgatttagattcatatatatgataagcatattttcggcaattgtcgcaaccacaaatttctcctataaaaatcgatacaacattgttatcgagcgatacattttccgccatgttattaccaagaaaaatggtttcgggaactgaactcaaatcgcgggttactcttggttgatcaaaatgtatgtgacaaagtgtagtcttcccgattgacttatcacctataaaataaaatcctgctgttttcgtttggttagcttcgatcgagtggaaaaaatttattgaaacaattttgtgagaaataaaccgtcgtcataaattaattttctgttgtatccaattttggttaattgccggtttcaaaatctcttgtcaatataacaacgatcatttttcatatcacaattccttcaggaatacaaaagtgctactttttaaaaacaaacatctaatcgttttgactaagtttgttgccatacttgcgagctatcggtctatatttgaatgaagccgatcatcctcagtacatgtactgtgatatggcaacgatagcccacaaatatggcaacaaacccagtgaaatatatttcagaacacattcaaatatggcaacagacttagtgaaatatatttcaatgtctattcaaatatggcaacaaacttagtcaaatatcaatatccattggggaacgatgaatttaatttcattacaaattataaaaaatataaataatcattgcggtggcagaaaaggctttcaaaaatcaaatgaaacatgaatttaataatgtattcacttatgcaaaaaagtcacttttgtatgaaaacgactttttgtgattacgataataaccgctccgataggtttttttagtcactttttaaaaaaatgtgttgccattttttgcataagtgcttgccacattttctgaatttcaggtggcaatgaaagagtttactttaaggaaatacattaattatatgaaatatttaatgaagtccatttataaacttggtgactttttcgagtgcaaacacgccaacaacaaagcatgcacaattgattgcgagcttcttaatgttagctttaacttggtcttcgccagcttcttcaacaagtttcttgtaccaactctttgccttttcttttggggtttgtgtttcattcacttgatttgtgcgatttactcgatttgcagtaaggttattaaatgtctctatggtaggctcgttgtcagctggtctttcgtagtaatcagttggtggttgttggtatgtattaatttctccttcatcaaaaatttcttgtatttcttcttcgctttccttttctatttcttcctcagcttcatcttcgttgtctagcttttcttcgtgtttatcttcaagatttatttgtgtttcatctttaacttcttccttgattttatctttttcatctagactttcttcatgtgtgtcgagatttgtttgagtttcttctttattttcttcaacaatttcttctttgttttctttgcacttatctgcagtatctttttgtacttcaccattatccaacttttctacactattgtcttcgttgtcagaactcgaagaatcagaagaatgttttgaactatcagattcagatgattcaccagaacttttacttttttcctcttcatttgtcttttccgtaactaagttttcttgttcatctgactttgtttggtcgtttattacttcttgttcgctcatttaattggtccaacaaggcaaaaaccgtttaaatccaaaaaaaaatcgaaaacaactttttatgaagaaaacatttctcttgcgttttcccttattaacgggaataactttgattcattagcccttaatactacctgaatattattaccattttgtcttaaagtagcaaaatatgcactatttggcaaaggtaaattaaacaccacacataaaattccgtttttatcttctgcaattctaatatttatattttctaaataagatttatctgcaatttttgcgtcattaatttggaatttatcttcattccttaacttatcccattccatatggaaataatcttcattaaaccataaataatcaacatgtgaaatcaaacagactaagtcaaatggcgcatcaaacattttgatgccatttgatgtcttaagtgcaatttgtatttttgtgttatcaacattaccaacgaagtcttcctggaactttactggtaatgatatctcgaatgattcaccgaattctaattgttgagggaaggaaggtaatttatcgagattacaacccatgatatttttattaaacgctatagcgaagtcgcctatattttgtaatgatttatttataactcttaaacaaaaattgaaacttgtccaaccagaaaacacgtcaataacatcatcagagtatactctattccattgattatctttaacatcttcgacattattaatattatcatcttcaggagtatataattgatttttaacaaaatcttcaggtacaatatgtaaaacccctgaaactttacctgtattttttaatattatatccaacactttattatccgaaattttttcattattaacaatttcttctttcttaaaaacgattatatcttttgctatatttatatccatagttaataatctccaataaatcaaagctctatttcttacgtcgggtaatatataaggttttattgcctcgtttaatacaaattgtaattgatctttaataatattttgattttcgatatacattttaacaattgctgataacaattgaatttgtacatcaatattttcatctttaaaagtatccaaaaaaggatcaattaatacgtcaactttctctatcatataattatattcccctaatatccatatcaaacaagatttagcttccgggtctttaattatttcgatgttattacaaactttcgctataattgattcgaattctcctggataattacgtaacaaattacttataacaacaatcgattgctcaattgcataatcagctttgttatcaacaagtttcattaatatgtcaatgcatttacgtgaactcgcaggaattttaattgcgattttcccaatgattcgaattgtcttctttacaaactgtacatcaactgaattacaatactcttcaagttcttctagtattaacccaacattacgtgctgtacatattattaatataatttctaatttctccatgcgaataaatgatggatcattatatttgcaaaaaaatgtccgaacttcattcgctaaaatatgcggatatttggttacaaatgttgttaatgtacgtaatactacaaattgtatctctacagattcactactaattaatgtgataaacggcggaatgatttgttggaataattcgttgacgtttcgtttgctgatctctaaataactataaatacatcgaaacgaaccaatgactactgacgaattcgaatgtttcagaaacggaattaatcgatcaataagaaaattggcttcttcacttgtggtcggaacatatttggacatcgcgtcaagaagaagcgccgtcatccattcgctgcattgtgtggtggcagatatgatcggagatatcgtctcttcagtaaactggaatattggagtgctccgcttctcgttgatctcgaggagcgccacacttgtgtttgcgacgaccattgggttctcgtcgtataacaatttttgtaatagtgataacagctctgaattctcaacggattcgggaatgacgtcgtacagcttggcgacggcaatggccgcggtcttgcgtacatacgcgtttttgtcctcgagacatttctttaacggaattatcatatactccgcaacggaatcgactttgatgcgacacatggaacggactgctaacgcgcggattatcgggttgttgtcctcggagtctttgatgaatgtattcacaaccataatcgactgctctggttcactcccggaatacgtgactaagtataagtacacaagcttcttgagctggatgtcatccgtttgcacacaccgaagcatcgatgaaaacaaacaactgacattttcgccgctgcgcattagattcacaactcggcgcgctgcgttcttccgcgatgttggatcattagagtcgaggttgtcacggagagtgatgatttcgcctttggctttgccctcaaaatactttgatgatttcatttctagcaaccgctggaaattaccaaaaattgccctttggaatgtacgttaagagtgtgtagactgaaaccgctcacttcatattttgatgaaaaactttttccttattcgaaaattttctacgcaatagacaacacacaatatatttagtaacttttaattattttgtatctcaacgaatttattttgaaatttctttttgtatgtgaaacaaaatgaagcacattattgtgaatgttatttaatttcttccaaacattaatttcctatgaaaagctttatagaattcgataaattccataagtgaatatacactgttatgttgacacaagcactcttttattcatagaaacagctaacactgtaattcgagaatatctccaaaaaggctacggattttgctgatgcaaaactcaaagtaaccttcaatacataagaaaatgaaatcaaaaatttaatcaatggaaatgtatatattcatgttgataaataaaatataggagctacagaacatttattcataaaagaggaaccaacaaacacgttctctcagtcgaatacatatagtcaatccaatccttattaactttattaatttgaaaaatctaatgttgatctgatttcaagatctaaggattttgttagaaattatttaaatatggatatgtgttctttataaaatttataatgttgaaaattgttatttcaacggagatatgtacaaaatatataatgctgtgagttataactttataatcttttattcataatcaatgaatatattttcatatctgatattggttcttctagaaaatataacaaaaaaattctgctttcaaaaatatgaaatttttcattttccttatgcaattcatcattaaaatttcgataaaataaatatttaataatacaaacaaatttttattctataaaaaattatttcatccaattttctcttacacaacattccattaattccaatgattcgaacttatcttctggtgatttcaaagtagcgaaagccaaatagatgcacaacaaaaacgaatataattgaacgacagcttgttttgcaattattaaatgtttcaaattcattaaatattttcgaatttcatccaaaattgttttcaaagacaaattttcaggttgtaattcgaattgtgaatttagaaatgttaatacttcatccattttatacttaattttattccattgttcagatataacatttaaaagttcaatatcgaaatctttttttttttattaaaactatacagtaaagaagacaattgaaactttttaacaaattcttttaaagaaatttcatttttatttttagatttcgatgcaaaaatttttacaaatttatttatttgttcatatgtaatattattaaaaaacattttctcattagaaattttagatttaattttatacacatttaacatattctcaaacctatttaaaaagtcattataataatactcaacacattttcttaatatattatgcattgcgatatcgcaggtcttgaaatagtcatttcgaaaatcgaattcaaaaaaattttatcataaaaaggcaaaatattttcgatttgattttagtatgcgtaacacagaataaccattaattatacatttcgctctcaatttgataaaaaacgcaatttgttcctcatttaaaatctcaaacaaaaactcaataaaaaaatcaatttcggaagttctttccatatggaagtttcatacaagtattatataaatcccaacaatattgttctgcttggaaaggaattttaaattccttttgtgaataactgataataaattccggaaatttcataattttcgatttgtttatcaaaatttgatttcgaatcataaatttcattcatttcatataatatccacgtaaaacttttgggtaaacgttgttaataatttgaagaaattaaattcaaaaaacgaatttcattttcattattattatttatatctatttcattatatttaaagtttgtgcataattatcatttaaagaaggtttaattgcatttttaatacaatttttaactaaaaacgaagtaaataacttaaaaaattgttatctttttcagtaagtaaaaaatttccttttaatattaaattaactttatttatgtccgctcgaaactcattttcatatttcattaaagatgttttaaataatgcaaaatcttcataagaattaatttcaattgttttatataacgttgaaatagaactttttacatattcgtttttaactaattcatataaatctttacttatattatttgctttattattcgaataccaaaatatgttttcaacatgacaatctcggcgtgaaataatttcattgacctctgttttaatatcattaatttgggaaattaaatggttttgttgatcatttaattctttgagatgcgtttttaattgtaaaattgatgatttatgattatcgattttattattaatggatgaaactatggagtcataatgagatttgatagatggatagaaccctttgtttcaacaaagaagcttcggcaattttaaatgaaatcacttcatctgtactctcgataaaatattgtcgaactacttcagaaaatatttcattgtacgatttctcaatattggagtttgagtctttttgagcttgagaaatgagtcaatctaatatttcgcttaaaatttgaatctgtcggtggatcatatggacccaaatatttaaaataaaacccattaggggcttcatgtggctgtctgcttttaatctcaactttaatgtttggttgtattatttcatttttttcagattttgtaatagaataggatgttttgggacgaattttctgggttctaacataagatttgaaacgtgtggttgacggggtcggttgtatttcatttggtattggaggctttgaataaataattgtatgttgagatggtgtttttcctaacaaacctgatctaacaagtgctggttcaatttctttgttgtgggattaggttgtatagttttatttcgaaagacaccccaagtaaagtggagtgttgcatcccagattctaacggatttttttcaatttgatttaatcgttgacaataaactgtcagttttctttttcttatagggtaatggaagaaaataaatttttccatttgttaaaagcaattcaaaatatcactttaaatataaacgaagataacatattatttgatgttcaagtaattctttctctttttgatgataatttttcatattcttttaacctcattatttgcaaatcgttatattcatcttttgcttcacgaataacagattttaatttatgttttgaattcttgaaagcaattgaaaaaaatgaaaaagaattaactaaaagtaattataaaattttagatatttttgcacaatttcttttaacaaaatcaactcaagaatccgattatcttctagaaaaattacttgaacaaaacataattagttcggaaattgttaaaaataagtcaacattatattttgcgcaatataaaactttagaagaaatcaaaaattcggattacttagaatatgaaacacctttttggaatgatttttttgataactatgagcaaatttcgaaagataattttaaacttcataaacaattaacttatgaaggggttaatccattaaaattagctataataatccgaaatgacgaaatagaaaagcttcaaaaattatcatcttcacaaaatgaatttgattataatcaaaaaattaaaccatcactttatgaaagatatacttttattaacaatgatactatttcacttattgattatgcagcattttttggatcaataaaatgttttaaattcttatttttgaatggttctaatacaacaaatacaggtaaatatgcaattgctggaggaaatttagaaataattcatatttgtgaagggaataaagtaatatttaaagatgcatgtgatgcagcaattgaatatcatcgcaatgatatttttaaatatatttatgaaaacaaaattttcgatataaaatatttaaatgatttagtacgaaaatgtattttatataataattatgaacttttaaaatattttattgataaaggaattgaaatcgatgattctattatcaatgaagcagcaaagaatggaaatttgtttcttgttaaatatttttttgaagaaaattatattccaaatgatattttggtttcaataacaaaatcaggaaacatcgaattatttaaatatattcttgagcaaagaaaagttaacatcaatatcaaagatatttaatatttttttatagcatttatttcgaaaaaattggatatatttaaatttattggagtttcttatcgccatttaatacagctcttatgattgcctctgaatatggatatacagaaattgttaaaatacttcttgaacaggaaggaattctcattaatagtagaaatataattttatatcatttaaaatttctttttaaaaaatgatatatgaaaataattttcggagttaaagtagattatttaaaacagcaatttttttgacatcacaatatgaaatagttaaattgcttttctaccgtaaagaaattgatattaatcccaaggctgtaaattttttcaatttaaaatttattttaatattttaatattttgaaataatgtttggaaattatttaatatattttggaaagcattaatttatgcatcacaaaaaggttataccgaaatagtaaaattacttcttgatcaaaaagaaattgatattaatgccaaaactatttattttttgcatttaaaatctcaatttataaattcagatttcaaaaatatatttggaaattgttcaaaacatttgatacagcacttattttagcttctcaaaatggacacacagaaatagttaaattacttcttgaacaagaagaaattaaagttaatattagaactatttgtttatattatttaaaatttattgtaataatttgatattttaaaactatatttagaagttatttaaattatttgagacagtacttattttagcttctcaaaatgggcatacaaaaatagtcaaattacttcttgaacaaaaaaaaatttatattaatgctaaaaatatttgttttatttatatgacattttttttgatgataaaatatttcaaaataatatttggaaattatttaaattatttgaaacagcacttatgaaagcatcttataatggtcatatagaaatagttaaattacttcttgaacaagaagaaatatatatcaatgctaaaaatatttatttgttttatttgaaatttattttaataattttttatttcaaaataatatttggaaattatttaaattattttcgacagcacttattttggcgtctgctcgaggtcatatagaaatagttaaattacttcttgaacaagaaggaattgatattaatgctaaaaatatttatttgttttatatagaatttattttaataatttaaaaattcaaaacaatttttggaacttatataaaatattttatacagcacttatatgtgcatcttggaatggtcatacagaaatagttaaattactacttgagcaaaaggaaattgatattaatgctaaaaatatatgtttattatgttcaaaatttattttattaattttatgtttcaaaagaacatttggaaataatttcaaatgtatgaaacagcgcttattatagcttcacaaaaagggtacaaagaaatagttaaaatacttcttgaacaagaaggaattgatgttaatgctaaaactatttatttgctttattttgtgtttactttaatcatgtggtatttataaataatatttggaaattaattaaattattttggacagcattaataactgcacgtagaagcaaacataaagaaatagttaaattgcttttcgaattaaaaggtgatgaagtaattgatgaatttaatatttgttccattaattgttcacttcaatcactagttattgaccaacaatatttcttatattgcaaaataaataaaaataatagtcatatagatggaagaattccattacagaaacaatacctgaacggtaaattttcagtaataaaataggtattttgtgttttttgtaatgatttccggaagaagaacattattccttataagacataaaagattttgatttccaggtgaggtggcgataaatatttgaaatgtttacttctatgtaaagcacacaacattggcgttttttttctgagctggaaaatgaggtcacttaatcaacattgccatctttttacccacaaaaaacctctctaaattatttccaatgtttgacaactctggtatggtccatacaacatataattcaaaaatagaaaatgattcaaataatcaatcaatatattttcaaatataaaatttactcatgcaaataatttcagatctcagccaagaaaatcttgatttatcaattaaacaaactatggatttatttgattcaaaatatccatttacatttaatcatgtaatttgtggtttaatttactctactttcaaatcaatgcgagataatagtgatatatatataatgtatttgaaggcagttcaaaccaaagaagaaggattaacacataacatccctaagctccttgatcaatttggtaagtatattgttcgctttaaagaaggggaatcatactatctttttaatgaaatgatagaacaacaattaattgatgtaaaaattcttaagaatattcaatcatattattttttgcatcttaaaacaaacatttttgatgacgatccacttagtaaaatagtgataaataattatgataaactttcggaaaataattgggagcttcataagaaattaattaaagaaggaattaatccaaatgaaattgcaaaaataattcgaaatgacgaaatcgaaaaacttcaagaaatatcatcacaagatgattttaattttaaccaaacaattaaaccatcactttatgaaagatattcatttattaatcaagaaaatatttcattaattgattacgcagcatttttttgttcaatacaatgttttaaatatttgcttatgaatggtgcaaatgtatttaatgcaggtaaatatgcaattacaggaggaaacattgaaatcattcatttatcgaacaaaataattcatcatttcaagatgcttttgaaacagcaattaaatttcaaaaaaatgatatcttatcataaatgacttcaaatatttgaaatttcaacacaatttatggaatttttttaatttgtttttaacaatttttatgattgtagttatcaatggttatactgaaattgtcagatatcttcttaaatatcaagttattgatagtcatgttaaggataatatataattcaacaatataaaatttctttgtattatttggaatttatatataatgtttagtactgctttaatgcatgcagcattaagcggtcatatagaaatagtaaaattattacttgaacaagaaggaattgttatcaatattgatgatatctatttaaacaattttgtaacttattataacatttgatgttttttctgattatttaaaacactttttatattaggcttattaaatgggtataaagaagtttttgtattatatattaaacgaaaaggaattgatgtaaatattctttaaaatattttgaaaattcattgtaatatttagaaattacttatcaaatttaatacagcacttcttctagcaacattaaatggtcgaattgaaattgttaaattacttcttaagcttgatggtataaacattaatactaatactatatatttaattcattttcattttattttatcataataaagtctcaaaataatatttggaaaatatttaaattattttatacagcacttatgattgcatgtgaattagattatattgagattgttaaattgctccttgaacaagaaggaattgatgttaatgctaaagatatttatttgttctatttgaaatttattttaataatttgatatttcaaaataatatttggaaattatttaaattatttgaaacagcacttattttagcatcttattatggtcatacagaaatagctaaattacttcttgaacaagaagaaatatatatcaatgctaaagatatttatttgttctatttgaaatttattttaataattttttatttcaaaataatatttggaaattatttaaattatttgaaacagcacttattttagcatcttcaaatggttatacagaaatagttaaattactacttgaacaagaaggaattgatataaatgctaaagatattaatgtttataatttatttttggaatttattattacgacttgaaagtgaattgatgaaagcaaaacataaagataataatgatattgttggattaatacttgagcaaaataagtttattctacaacaagaaaaattagacatcaacgataatgtttcaactgatcgtagagataatttcataccaagacattgtacttttgaacaaactggatataaacaagtacaacataataagtgttataggtgtaaaacatgtatgtgcaattactcaatttgtgaggaatgcgcaaaggtttgtcataagggacaccaagtaatttcagtgggtagtgaaaaaatgttttgcggatgcggagcaggtaatttcgcgtccccatgtaaactaatttcaaaatgtaaaactcaaaataataaataaagattacattaataagaaaaaataaaacaaaaattttacttttcttcgtttcattattatttttaattgaaataaaaaagtaaatttatttgtttttaccaaccatacataatagcaggattagattgcttagtgtcgtagctttggaagccatcgcttctcttttcgcagcaaacgcgtttgaacgcaaagacaattccaacaatcaagaaaatcgaacatatgattaatatgatagcaatgattttctgtgccttagagaaagttgcttcatacgcttccttacatgttctttcagaaagtgctggttcatcccaatacttgcaatcaaaatattgttcaaatgaagaagcaaagtctggattatcattaaactcacgagagacaaattctgtaagggaagatgttattgcaaaaagaacaatgatatttaaaacaatataaatcgtaaaaaatatatagattgttgcaagaaaacatttgagggatctatttgaggagaatcctgcaaacgttgaaaacacgaaaataacaataaatatgaccaaagtaatgattaaacctgttctaagtgaattataagaaatggtttctgaagaatggtcaaaaatatataataacattgaaattagtgcaatcatagatcccattgtaataagatttagtattgtataaccaacaccaccaatgtacttagagcaattcaccatgtgcacgtgtacgttatttgccaaataaccgtccggatggtattttaacggtcatttcatgaacggtgacaattgtcaaatttgcaaatttttgaaaatgatgttgaatgcaacgatacgaattaattcaatttacttgttataatattaagaattttaaaagcattcaaatttttgttgtatcgcatgcgttattttttatttccatagaatatttataaaaaagatatttgtttatttgatatttcaaatttatatatgaaatttatttgcattttttcaaacagcacttattattgcatgttcaaaaggatatgaagaaattgaactttttcttaaataaaaaggaattcctttttatctatcgatggatattaatgctaaagataacaatggcaataaagcaatagatttggcaggtaaaaattttaataataaaattgtgtcatgtatagaggcaattaaatcatctttaggggaacaaaacatatactcaaaccccatcggaaggagttttcctacaaaaaacagtagtaaaaaacagaatccgatttcgtgtagtgagtactaataaatgtgtttctttaatgtaaaacaaaattctagttttatataactcatacgcaagtgagtaaacttttatcacatcgtacattccaccaattttatataaataaagaatctgatgtattaaaaacatcgaatcattttgtttcttttgtatatgtttagtggataatatcaatgcttctttccattttccctctaaaactacttaaatgataacattgtcttcgtaaatatgtatatcagattctggtgacctaatacctttaaatgtagtttataaaaaagacatccataacaatttaattggtataacatgaacttgatcataattaatttgctaaaattctaatactaacattacatcatgctcataaagggaatttgtaaaatgttatgtcaatggatattttttgctgtcctgtagtgtatgaattctaaattgaaaccatcaaaaatattttcaaggaaattttaattaaaaaatttgaaaaatatttttataatataaattttattctacaaataatatttatatcgacttaattgcctttatccatttttccaattggggtccaccacccaaatcttcatctttaagtaattcgctaaatatttcttcgcgtttatcgccttgtagtataatttccacctgcaaatattttgcgcttaaattccaacaatcgtttatcaaattccttaaatttctattttcatttgtatccaaatttggaatttccattttaactttcgaaatttcatttacatcgaaagtattctccaagaagtcaatatttacattattacttatccatatataaattctatcaaacgtatgaactaagaaacaatttccttcggcaaatgattgtttcgttaatggcacaatcataaacccatcgattttatccacgacaaacattcgcggatataaatataataacaaatcaattatattaatcgaacgtaatctaattaattccgacattcgtccgtcggaaccgaatttatgttttaatgaacgcattgatgtactatataacaatgaatgaaccaaatgatataatgaaacaaatgttttatcatttgtggagaatatttgtgaaatatcaatgtttaattgtgacgtattaatacctttcgataatgttaaacttatgaatcgtttcgtaatcaaattaattaatgatgattcattaatatatcgatatacgtcatataaattagtcgtcgttatacaattaaatgtaaatacacgaatcattcgtcgactattaatgtctgtatatatcatcccaacttgaaaagtaatgttcttcggtaaatttccttggatttcaatctcaaatgtgatcgagtcttctttcgaaatgatcggaaatgatattaatgtgtttcgtaagatacaattcgtatgttgacgaaaaactttgagaccattcgtacagcgtaatcgtaatgtacaatcatataaatatttgttggttaacgtgtgatatatttccgaattcattttctggcgttggaattcattaaagtcttcgtaatgatgaatttgaccgcatgttagtccagaaggaatcgctaaagtggaaatatcagagtattcagcacccgctgtgaagacatgaacagatacattcgcattgttaagtgatatcgcaacgtctctataaaatttaccacttccatccggtggtgatttaagtaatgaactttcatcagtcgctgcacgtggtcgtaacaaatgaattccatattgaggcatacgtgtgaatccggaaatgattatgccgccgttaccattgagtaatttatttgccaataaatatgccgaccctaaacaatgcccatgaacactctcagagggaacagtgtttagtaatgagtcgattatgctcaagaatgactccgaacagttgggtttgagcggaaatagatttgtaaatttgattgaaaatggtggatcagtgacatcaggaataacatattcggtacaagtttgaagatcaaagatggatacatgcgtgctcatggtcattagacctatatgatatttatctggaattgatggaaatgctgccttgattgaactaagaaattgggacgtaaaacctatagaataagtagggtaagacatgtcgattaaaaataagaaaagtggttctgatcgaattttgatataattttggggagcaataacatcataaactgataatgaaaattctggttgcgaaccaaatggtatatgagttttgtctgttatttcattaggtttaccacaaatgccacaattccaagttttaccatcatttgatactttgcaatttggacaaaggtatccatgacaattaaaacacctaggaactttgtcttgtgagtgatcaatttcttcaacactttcaacaagagctgggcgtaaaaccaatccaaacggaaatttgcattgtttagtagtatcacgatttgcaggaaaagcttgtgttactgttctgaaataaggtggttgtggtgatactccaggaggtgttgcagaatccagtatttttggatttgcccatggaaatgtaattcctactgcttgagtttgaactgcattttcgtagttaggtgattggggaactgttggtggctgtgttgcctccatctcaggatttctatatctccttgccatttgaaatgtacccaaagtcaaaaaccgtatttttattcgaatgcaaaaaaattgtccaaatcagagaatgaatgattcctttcttctagcaaataaattaccaaaaatttttgatttctttcttcctttttcgttttgctttagttatggaatcaaattaaattaatgagatctaatttaaaaaaaattgtagttaaatattgcgtttttcaaaacatcgtcaatgtattaaagacatgaaacttcgaaatcaaatacagattggaaagagcttgaatgttttttttttggagcaattttgtcacttttttatgtatgggttcgaagacgtaacactcgaatttattgataagttacgcaatgttcaaaactaccttaaatgtgattctgcattttctgaattggaagacttttacatccaagaaaatagtttagtaacagaatcattttatgatgaaagaaaatacgagctcaaatatttttataccatgatatttttcttattccagtttccagagcaatctagtgatccaaattttgtttcactttataaatcattttatattaataaagcaaaaggtaaaggtatccaactaccagatatctatgagctcacaaatgattgcttatcacaaaccaatcaatatagttctagtataagggatatattaacattcagttttatcccatcatttgtcgatttttttcttacagattatgggtgcaaactttatatagatattcttaaacggtataagaatgatacaaagaagtttaattgtttagctcgtggtgtttttttctcaccattctttttgaattttgtatctaatgtctttttaccaattctatctccgattctcgatcaacgtgagcctccggatcaagaaagtatcataagcgcccttaaacgtcgatggaattctcatcttcatcttcttcatccaataattcgtgatgtacttaatgaatcaaagaatcctgcaagaactttatccgaaagtttctttgaaattgctttgactattccaacaaattcgagattttcgtatacatttgcaaatgtttctttacttattgatttctttcaaaaaccaacggaaagctttcttcagttccttcgtaattttcttacatataagtcaaaagattgtgttctcggcgattttttatttaacgaaagattaaacgtaaaatttgattttgagccgataaccgccgacctcacaaaaatatttttaaacgtgcaaaaaaccgttctatcggcagtcgacttttccgttataaacgttcgtctttgtaacagtacttttgtgtttcagccacaatttttccttgctgaagatgtaaaacgttgtgagaacaaggataatgaccctaataatgcaactgttaatgctgaaagtaaaaagatggaaaatgctctgggacatcttcttttcttatctgataaaataccagtctttaaagaagccccaagccttgacattgaatcctttattttagagtatcttgttaatcgaggtccattagaaacatattctaatcgctgctcatgtaatgaagccttaagcatcaccaattttgatcgaattggtgatcttttggataaactagaagcagtttgtattcagcacaagaacaaaacgcgatttccaaatcttaattttttacaagaaataaatacccaaatacaaatcatcacctcaaccttaaagccaatgagcaaacaattgtattcattattgttatacaatgaactcaaacatatgcttccgagtacagtatctgatcttcaaatccaaaatcaagtcgaacttaatgcacaattcgacaacttttatggctcattagcccccaaattcaaaggccgtcaaacctatttgccaaaagttctatattcgatactcaccgaaaatattcgatttgatgaatacactaaccaacatccagaacttactgaagttgatcgaaagatcaaaggatactatagagagcatttatctgaggttcttcaagacaaatactatggtctagcgaaagatatcaaagataacgaagaaataatggagctgataaagtacgcagtgagcgaaaacagcccattgcgcatgcacaacgcgcttattgagatcataaataaagcaaatattttattgcacgaaattgatacaggcgcaggtgaagatcaaaggctaccatttaacatagcaatgttcgcacaggctgcggtgtatatggacaacattcgactgggttcatgctacacgttcttgaatgagttttgtgacaatgagatgtcaaaaaaggtcttcccacaaataaattctttgatgtcaccactgaaagtggttatgaactctgctagcaaatgattattaaatactttgattcgttttggctggaaaattttatgaaattttggggagaattttgttaaaatttttattgcattactcacatcggttttaattaattgtgtaagaaggttaaaaatatgatattttatgtttatctcaaaccattttgttgcaggagttattcaattattttggtgtcacccaattgaatatttcatttccaaatacattagttactattaatgtttatgcttttggttcatgttcgaacttaacatctattattattccaaattcagtaacacaagtcggtgattatgcattcgtttcatgttcctctttacattctgttgtaattggggaaaatgtcgaaaatattgataaaacttcctttgaaaaatgttctgctttgcaaaatattacaattctttgtccatatataaaaacaattgtaactaatctaaaaaatattgaaaatgtaatcataggtgatggaataccaaaaattgaaatgaatatctttaaaatccttcaaaatttaaaaactgttattgttggaaataggacaacattactagacatcgaagcatttaaagaatgtggatctttgaaaagtatcatacttcctgatacattgacgacaataatgtgttcgattgttgttattctttagaatcagttatttttgggaataatgtaactacaattggcgattatgcattttatatatgtataaatgtttacagtaataattattccagataaagttacttatatttgcgatcatacctttagttattgctataatataacaaatttaattattccaaattcagtaaactcaattggtgaatatgctttcatgttttgtcctttagtaacacttacgattggaagtagtgtacaagaaattggttcaaatgcattttatcataataatattttaaacattactattcttactccatatatgtcaatgaaacagatagtggaatattgtggtaagaaaacattagaaaatgttataattggaaatgatgttacagtaatagatgattctgcatttgattcatttcagaatataaaaatgcttatcattggaaataaagtagaaaaaattggttattatgcatttcgtaactgtgaaaatctgaaatgtattacaattccaaattcagttatcaaaattggtgattatgctattcaaagatgttattcattagaaacattaactatcggatgtaatgttagtatgattggtgaaagatcattggaatcaaattccaatttaacaaatattgcaatccttagtccatatatatcaataaaactagtagtttcctcatataaaaagacattgacaactgttatcattggtaataatgtaacaacaatcgatgatgatgcattttctgggttttataccttaaaagaaattaatattggaaataaagtagaaataattggcgaaaatgtaaaatcaattgataattatgcatttatgctctgtacaaatttgcattgtattaattattatggtgaagttgaacctcgttataaagataatgctttctatcaaacaaacatttataagcctttaatgcaaatattaactgttagatttccaactgaggttaatcctatcaaacgatctatgggtccacttgctataattatttgtccaacacgcgaactttgtcttcaaacatattcagtcattcataagatgaattcaattattaattttattgttgccggtatttttaattggtggtgaaaaagttaatacagaaaagaaacgtattcgaaaaggtattaatattttaattactacaccatcacgctttttatatcatcttcataacacgcaaaatttcaaatcttttccaaatttacaatttttagttttagatgaagccgatcgtttattagatttaggatttttcaaacccattacagaaattattgaatcgttaccaccacgacaaactattcttatctcagccacattaacagaagaccttaaagcgttaacaaatttatcattaaacgatcccattacaattggagttcatacagaaaaccaaaagatttttcaattccaccacaactacaacaaagatatcttcttgttgatattcgccaacgattagtaatgttagcattattattacgattagaaataacgaatgcacgaagacgacatactgggatgaaaagtatagtatttattaatacatgtgattcagttgatttccattatcacttttttagtttctttgattttaaaacagatgcagaacgtggacatgttccacgattacaatataatgaaatgcagaaacgaaacaaacaagaagccacgattattgatatccattccagcacagataatgatgaaattggttcatattctccatatttaaaatgtccaatatttcgaattcatgggaatgttgaacaaattgaacgatctaaaacgataagtaaatttacatcagaagaatttggagtattattttgtactgatgtcgcatcacgaggtttagatataccaaatgtaactactattatccaatatgattcaccacttgataaagaagaatatgttcatcgaatagcgcgaacagcacgtataggtattgaaggaatatcacacattttttaagtgaaaatgaattaagttttattcaatcacttcaaaacagtaaaagttaatattaaagaatataaatgtaaagaacttattaaaaaaggagtttcagcaatgaaaggaaataatgaacaaaaagcaattaatggaatgaaacaagaaacaatgtcaacagttgaagagaatgatttaagtgaaatggcaaaaaatgcatggcaaaaaactatcaatgcttacgcaacacataaaggagaattaagaaattatttccaaaaagataaattggataaaggtgcgttacttgattcgttttgtattaaggaaacaccaagtgaaatatcaaatgaaagaaaagaaatgagaaaattaatgaaaagattaaaaacgccaagacaaatcattgacgaaacaatgttattattacctgaaaatgcttatgaaaataaagtgtccgaatttatataaaaaaatgatttttagtaaaataataaaaaagaatatttttgacacttttatttatttaattaagaaaaataatttttataaatttatgtcattttataatttattagtaggtcggtaaatatattgttataataattaattaaatgaattaagtttaaaaagttttgcatagtattcatatagtaatttgcagattgttatatatgttaagggaaaatttttatgatatatttttttaataaaaagagtgatcactaaagaataaaccaaaaaatatttatataattaattgtataataatatttaatcacaaatatatataaaatgaaagttataatatcgttgtaattaatgtaacatttcttattaattaatataaaaacatattccataaagcaatggttttattgtttggttaaaatcaaaatcattttgtgatgatatttctcaataaaattctataaaaaatataaattatatttctttctttcaaatatttatgataatcttaacgttcgtcgcatttcttaattttacaaatttataaaaacggttaaatcgcatcaaatgattttgatgttctaattaaatttttttaaattcctttaaaatgcatcatattcttacagctccttatgaaatcatctttgatttaaatgatgataacatagaatattcagttcagcaaacaatcaaattattaaatactgattatcaatattcgtttaattatattataattcaatagatttattctgcatatcacttgcggatgaataaattaaatctatatttaaattatttaaagttgttacaaaaagaagaagaagaaattaacaaaaatttcacaaatatcttagaaatatttattaattatgtaataaaaaataaatcaaaagaatcaaattatattattaataaaattattacaaaaaatttaatcgatcaaaaattagttcataaatttaatttaacaaatttcaaatttaaccaaacaaaaaaatcaacaaattcaaatgaaattttaaaaataattcgaaatgatgaaatagaaaaacttcaagaaatatcaactcaaacgaaatttgactttgatcaaaagattcaattatcattttatacaaaatattcattcactaatcaaagagatgtttcattgattaattatgcagcattttctgggtcagttaaatgttttaaatatttacttctgaataatgcgaatgtatttgatacaggcaaatacgcagttgcaggtggaaatatcgaaattattcatttatgtgaacaaaatcattcatcatttgaaggagcttatgaagcagcaattgaattccatcgaaatgatatctttagatatctttacgaaaataatttggaaaagtcagaccaaaacaaacaaactgattttgatcgaaattatttatcgttggtttgtgtagaaaataataatttcccacttttagtatattttatagaaagtgggttacaattcgatgattccttattaaacttatcagcgaaatatgggagtttgctttttattattaataaaaattcccatatcccaaaaaacatattgccttatgctgcaaaagcaaataattgtgaaattattaaatatattcttcaacaaaaaggaattgatatcaatgctaaaggtaatgcttattttaataattttatgtttcag

SEQ ID NO: 29 - DNA, 154246 bp, Histomonas meleagridis
  misc_feature: contig_106_att
agtgaccttcgttcggattacatgtattactgacttagaacctacgaaaaatacgattattaccgggacggcgaagaagggggcgataccagaacggtgctctcaatggttattcgctaatctgaaagtgtttcaacaagatgttcgaagaccgggtttgaaaaaagccacgctgatggctgacgatcatttacccaagaagtcagttcaaatgacccatggactgtttttatcaactaaataatcagacaatttcagtttttatcttaaacactaatttacaaagcaaaatatcagaaataatcacatttaattgatacttttggttttgctcagtcaattgataatttaaagataataaaaacaggtttgtttataattaatatcagatgatcatactctggcgtttatgtatatttctgttggtctgggtattgggcggaaaagactaataataactaacaataaaagaatggaagcttaatgaaaattcattgtcgctgcaaacaatgacaatacaacatggtgctggctgttgctgtgaaggaaaatattccattctgtcccaaatataaatacacatgcagccatagaagatgaccatagcatgattggaaggtgctttaagtcagagaattgggagagatattttggataattcaacactcaaactctaagaaatgggttggttggaaaccattggagatataataagggcaatatgtacgtatcccattcacattgctggtcggacggtgatcattgggtaaggaagcaaaatgataattcctctcaaaatactttaaatggtttaatatgacaaacagttgaaacaatagataccaaagttgttgtaaacagtgtgataaaacaaaaaatcagaagttaagaaacaaatagtgaaaaccgacgatgtgtgacgaatgatgtttggtcaggattttcaatgactgcttgacaacaggttagcagcgattgtacattcagcagtgctttagttgtaatcttccaataaatccgatcggagaaaacaaacgtagcggccggtttgaatcttaatcaacgtctcttccaactgagcattctaagcaaatgatgactttttgaagattgggttacagcctatggtttttaaggtgggtacatgataaaagggtgattatcagtcattaccaaataaaattcactttgataaaaatcaaacaatttgtttgacagttttattacaggagctcattaataaattgatatctttggataagatgtaatgattggttgttgaagttttttatgtaactgtttgccttttcatcaaccttcaagtgccgaatgacgatgattcgatggtgtgaagcaagtgatctcagttcatcgttcccggcctcatctcgaactttggcgtttgcgctataaccctctgagcttcgcaattatggcgcaaaatcagcggcgctgcagatgattgcaagtggaaggaagtgtggaaaatggaggaaaatgtctttaatgatctaaatcgtcgttatttgctgtaaacacgagagtggttctttaaaggttgagaatcttcctaattttattcttcaacagaaaccagaggtcagttctgggcacatgaaggaggacaaaccctcaacttcttcgtactgatctgcaccatgatgcactcttatattcacctgtgttaaatctagcaatcgttttaattattctcgattgacgcgttttaccttctgtagttcttggtattatttcttttcaattgttttatcaaattcctattacatgtgttggattcagagactttcacattttctgcttttgcagatctctgccatttctgtttctgttcatctcctctgtaccttgttttgttggaatgaggtcgttctttacataatcctgtaacttgtcttctcggtcgtagcagctttgtggacaataaagactgttagttcctgagtccgcatctaaaaccaaagcctaaaacagggcataacatacagcattctctttgtcatcggatcaattcaggattagttccttttattgtttggctgggtctgatgggtaagcaataatgacatcaattcagattgaaacacagtgctcagtagagattttatgctttaacaaatcagttgttattatggaaaatgtttgcattttaacgtctttttatattttgtcatcagctcgaaatgttcttgaaatggactctctggacggaaatagcatgcttcatttttaacaggaaaacgacgcagacgaaatcaaacaatgtaagcgagctagtcaaaattagactatggcatttcaaaatattgatgagaaagacaattgacgatggtcgaataattcttctttttcgatctaattcttcaccacgaacatatcgattagttgctttaataaaaatgggtttttgaaatgtcattgaacgtatggtcttcccttaatttcctcctcgtcactccattcagtgatagtaatcttcgctctaataaatggtctcatttcgtaactacttccacttcaaccgtttacacgactgtgtcaatatcgtgattccactttcgaagttgacagaaccacagtactcagttgtccaatctcatttgtcgttcaagtcgttatcaaaaccgcaaaaccaggtcgagacgtttcagcctttttcaatcgtagtgcgagttgctctgatccagaaatcctgctcaaagcctgctggaagagtggcggcagtgacaaatccccaatcgtctggatgctgtcgccaccaagaaggttctaaccagacgagtttggactcttgtttgagcagggtgaaggtggtttccaagaactcaagtctagcatcgtatgacaagttctgtcggctatgccgatacctccgtcgtttgcaactggtgatgatatgtcgaacgttcgttcagtcgtctttcatcgatctatcatcgcgaaaggcacgcatgagcatcaaggaaccaagatgggcgatccatggggtgatcagcagaagaaggtcatcaaccaaagtctcaatttcatttcatctggattcctggtaccagatgatcagaagatggaaatcagcgctcgaaatctctgcaaggctggtgtacatgcttcaaacccttacattgaagagactttttaatttttgagcacctatttattactgctgatcacaaaaatcatctgagatttatctgtcacttttgtctttgctcggccacaataacatgaaaatgaattaaaaattgctataaaagagaactatctaatcatgaatcaagaaatattggtggctaacagacatatctttgagtataacaatgaaaaccttacggatcattaaaatacattttcatgatgatgggttacttgttaaaactcgtaaatacatatgcgctctttattgggattatgctcaaaaacatctgtctcagcttcctttgtcatataaaaataatgttgtcgaaaatagttaacattattattttgatgaaatttagaatctattaatcaatgaatgtcatagaaatacaaaatttcatgtgaggaatataatcatttggatcacaaaagacaacaaacaacacttttcatattggaaaaagtgacaacaaaaaatgcaatctatcgtttatatcactttatgaacataaaggcctgtatcacgtgggaatttgcttcatttatcaaataatatacacggaaaatgtaatatcaatgataaatttgtttttcattgaaatttaaccttaaattttggagttcatcaaaaattattaaaacatgtctttatgaagtaataaagtttttcataaacaaatggaattggtttaaatacttcagttgtttgtttgtcttagaaaaagaaaatcttaaagtatataaagattattatccaatctggatatgtctcttaagtatcaattgattatttaatttgagtcccagtgcttacaattgatttgcactattaacttttatttaagtttattgggtaaaaatcataaaattgaaatcagatatttcaaaaattttaaaaattagcataaatattatgccaaaaaatgatttactgaaaatttttatgttttaactatcctgtaatcaaatggttggtctttcggcataacaagtaatctttttgcaccttctgaattgatttgaacaacattgatgaatccgccagaggctccatcacggacgattgcattgttgacggccgaaattgcaaattctgttgcttgttccattgtgaaatcttcttgacaattatcatcgcaataagctgtaatgtatgcgctaccactaccgttagcagcaaatttacgcttcaaagccattccactaacagaaatttcccaaactgcaggaccatcagaatcacatccagcacaaataaatcctgcactaagcatttctttgttattttgaattaaccttgagaggtgatgagcggcaatagaaacttgatgattaacatctctttctgtgttcattttaactatatttaatgcatattttgcatacttaccaagtgtttgagtgtgagctgtagttccggttctggcaatgtatactgttggtgaaagtggtgtaattttgttagaagcgcgtgaagaaacatattgtcccatagttgaacgtgaatcagctgccataacaactccatcagtacattggattgctaagattgttgttcctgtatgctcagtcattgatgaatcgggccccaaacattgcgaataatacttaactatgtgaaattttgattaactttgtttgaccaactatcaaatggaatgatatgtgatgtgaaatgatcaaaacagttttaatttactaaatagccaatgtattgtttactaattatattctccctctcatttgagctagtaacgtcgttgttcagtttttatctcaattaagttaataagaacatttgttaaagaaatgcacatataaaaatttttcacatttttttgcataatgacatcattgcttagtaaattaacaaattttagtgtaattacaaaaaattcaagcacaagaattttttaaaatttttttatgtaaatcccaaatattttatcgatatttacatattttgacatcgttataattacttcatgaataatttttttttatatactagaggtacttcaactcccaaaaaacagattttttttcttcttttttcattccatatgtaagcattccatgaactatgcaataatttatattttagatcataaaattttataaactcatgatatattttttaatcgatttttttaaaaaatttattttttccagtcattcatgattaatttatgatatattttatattgtattgattttaggacctgaaacccaccaggaaaaaaaaattcattcaaatttttcatttttttctcccatttttttaaaaattgatgaataaaattatataaagtggtgacctggtttattttagatatttatttttagcataacttagaatcgttgttttaaaaattataccaataaattttattgaaatataaaaataaaaatattttataatcgtaaaagtgctgtaatttccaaaatattcattttttgcaataaataataaaaattaaaacataataaccaacacaatcaaattcttttatgtcatcggattatattttaaaaaataatgaatttttatttttatatttcaataaaaatgatcagatatatttttatgttttttttttcgaatattttttcaatttggtgataacataatatgttgaaaattaaatataaatgaatttgttttataacaaactatcttcgagaaattttcattttttaattttttattaaaaaattatatttttagtatccataataaattttttcatattatattaaacacaacttaaaaaaatctatcgaaatcttcactatcgtaagattcatccattcgatctggattaaaatgtggttgttctggttgtgattgtggaatttgtacattagttctagaattgattttttccctaatatctttaagaacttcatcgagaacttccaaatctttttttaagatcttctcttcgacaagcggaatatacacagtaacatcatcaatactgatgactattgccttgatttgtctccagccatatcttttccttcccataatgttttcaatgaccattttctatcctcacacgctattttgatcgttcacattgaatctgcattcaaaaagttgggaaattagggcaccccatccaaattttgcccaaaaatgatgtaaggcgtgttacgtgggcgagattttaaattcaaagtaacccttgcaatgtgatacgatattttctatgtgattttagtttttgtacaaaaaaacataatctcataagttaatttcaacaaaaatgaaaaagtcaaactacatgaagagaccaatggcttcataatgtacaagcgcagtgtatgtttggaaatttaaaatagttcacttaaaaaaaattattattattttgatttcaattcaatcattttgattctttcatcgttgtgttttacgcgctttgtaatcttgcctagtctaacagaaagtttatccagttcatttgctatatctgaaaggaaattttgataaggatcattgactctttcctcgcattttacaactctaaccaagcaatttcgctttggttttttgcgttttttcgtttttgtttgagtatttcgaaaaacagaatcttgggataaaaatgtgttttcatggctaatttttcctacttttggctcctgaaaatccaaacttggttcctctgtactaatttcctcttcttctggcgaaacagaaagatctggtgataaccaataaatcactttgcggtctcttccacaagttgtaaaatatttaccatcactcgaaaacttaacatctataacatctttctcatgtgctgagagagtaaatatagactcgaagttatttgtatcagtaataattacagaattatcagacgacccggtgacaattatattgccatttggctgtatggcaacagaattgatggagtcgctatgtattttcgatgaatgaaggatacttccaaatttagattcgcataagaaaagtgagccatttgaagttccagcagcgaggttatcaccaccgcctgagaaggaaagggaaagaatattagaatatgtatcaaaagtatgaagaatattacaacttcgaatatcataaagtcggcactttccatcaattgaacctgtggcaactaaagaactatataagctaatagccgttgaactaagctctttatctgtgattggaaatttttgtattatttgttgagtatttatatcaaaaagagaaagagaagatgatccacctaaaatgagaacctgatcagcatcttgtgtaatagatagagattttatggaaccgaaatgtggagataatttttttatacatgaatcattattatcaataactttccaaaaacggatttcttcatctttgcttccagtaataataagactttgtgaatttgatgcatcaatacatgtaatagtatcatgatgtccaacaagtctttggcatgtatcttgtttgttaagtggaaataaaataatgctcttaccagtggttcctccagctatatacctatttgtgaatggaatggcacaagttagttctccattccttacgttaaatgcttttaaaatttttggtttcattgcaaaagtgttgaagaagaaattcgaacgttttaaacatatccactttttgagaaatttatatttgataggatcaaaatagattcaaaaagttatcaatcaagttgttttggccaaaaaaattgtgtgtgattaatcccaaagctattctgagtttatcaataaaatacatatacgtattccaaaatcatgagttacaaagaaaacttaggatattgtactgtcagaaatttcaagtcacattaatgtaaatcacaatgaattaagcaacaatataaattttagtgatattacgaaagtaagttacacttttagaattattacatatatgcaaagaatttgtattaaataaaatatcctcaaaaatgtaggtcttcgatgtgtactatatggcttttttgatattaccacaaaacctttgaatataacaattagtcaatgaattacaaaattgtgcccatgttcacttcattcaattattcgaataatttttatataccactttgaaattttaaaataaattctatataaaacaaataaatatctttagcattaatatcaattccttcttgttcaagaagtaatttaactatttctgtatgaccttcagaagatgctatcataagtgctgttctaaaaaatttgaacaatttccaaatattattttgaaatattaaattattaaaataaatatcaaataaaacaaataaatatctttagcattaatatcaattccttcttgttcaagaagtaatttaactatttctgtatgaccttcagaagatgcccatataagtgctgttataaataaaataaataatttccaaatattattttgacatattaaattattaaaataaattttaaataaaacaaataaatatttttagcattaacatcaattcctttttgttcaagaagtaatttaacaatttctgtttgaccattataagatgcccatataagtgctgttataaataaaataaataatttccaaatattattttgaaataaaatattattaaaataaatttcaaataaaacaaataaatatcttcagcattaacatcaattcctttttgttcaagaagtaatttaaaaatttctgtttgaccattataagacgcccatataagtgctgtataaaataatttaaataaattccgaattttattttgaaatattaaattattaaaataaattttggatataacattgaaacatttttagcattaatgtcaatactctcttgttcaagaagtaattttactatttctgtttggccattcccagatgctctaataagtgctgtccaaaataatttaaataattttcaaatattattttgaaataaaaaattgttgggataaatattaaataaaacaaataaatatctttagcattaacatcaattcctctttgctcaagaagtaatttaactatttctatacgaccgttccaagatgcaagcataagtgctgtatcaaataatttaaataaattccgaattttattttgaaatatcaaattatcaaaaaaaatttcaaataaaataaaaaaatactttttgcattaacatcaattccctcttgttcaagaagtaatttaactatttctgtatgaccattctcagatgctttaataaatgctgtataaaatgattcaaataatttccaaatattattttgaaatataaaacaataaaaataaatcttaaataaaacaaaaaaatacttttttcattaacatcaattccctcttgttcaagaagtaatttaactatttctgtatgaccttctctagatgccaaaataagtgctgttccaaataatttaaataatttccaaatattattttgaaatatcaaaatattaaaataaattctatataaaacaaataaatatctttagcatcaatatcaattccttcttgttcaagaagtaatttaactatttctatgtaacctttttgagatgcccaaataagtgctgattgaaataatttaaattatttccaaaaattattttgaaatataataatataaaaataaattttgaatataacattgaaatatttttagcattaatatcaattccctcttgtttaagaagtaatttaacgatttctatatgacctcgagcagatgcaattataagtgctgtataaaataatctaaataatttccaaatattattttgaaatatcaaatcattaaaataaatattaaataaaacaaaaaaaatatttttagcattaatataaaatcctttttgatttagaatgtatgtaacaagttcaatatttcctgaagatgaagcaaaaactaaaatattttctggaagttgattatttttaaggaaatattttacaagaaaaatatttccgatttttgctgcttcattaatgatatttacattaattttcattccttcattttctagatatgtaaaaatttcataattaaaatatgaaacacatattactcctaattcttctaattttttaaatttttcgagtttgttttcataaatatatttaaagatatcatttcgatgaaacttaattgctgtttcatatgcatcttcaactgatgaatgattttgttcacacaaatgaacaatttcaatgtttccacctgcaactgcatatttacctgtgttatttgtttttgcaccattcataagtaaatatttaaaacatttaactgaagaaaaaaatgctgcataatcaattaatgtaacattccaattgttaataaatgaacatctttcataaattgattttggaattgtttgattaaaattaaaattattttgtgatgatatttcttgaagtttttcaatttcgtcatttcgaattattttagcaatttcttttggattatgtccctctttaatatatttcttatgaagtgcaaaatcattcttcgaaagttcttcacaagcaatattttcttgatcaaatgaatatttatatttatcaaatttatcttgattaatgtgagcgaaaaatggaaattcgcatttattttgaatgacttttgcttcaagtaaattataattaatcatgtaattaagaaagtaaaatgattcttgtgtatttattctaagaagaaattgagaaaatgagtctattatttttgaagtgattttattattttcttcaaatttttcaatttcttgtaataatctcaaatatatatcgaaattgttacttttgatcaaaagggaattatatatcattcggcttatacttatattataagatattgaatactctttacaaaatttgctgattataaaattcgatgattgaataaaattctctgtattcaaaccaaagattgtatttttgagcattacaaatgattcccattcattttgagattgatttgtttcacctctttctcttttgttgttcattttgaataaataaacgaatcgatacaaatatgtaaagcatgcaaaaagtcattttatcgatttttaagagtatcttcttcaaaatattccacatctaatgttcatacgtttcctattctttgcttgttatttttgttttttcacatatttcaaaattttaatgaaacgaaaagttctcattttacaaatataccaacgatttcaatttattcaaaacaatttacaaaacaattattttgtgaatgggctcttcaacttttcctgttccacatctatccatctttcaggcaacaattgcactgacaatgtttttcctctttgtgcctttatcaccaatcttttgacttccttcaaaggcttatcgaatcttattttaattttatctgtttcgttcactttcaacaacccttctataggtgtaatatacaaatcctttggtattgtatcttttctaattttccatttgacccacaccaaagatttattctttattacaatttcttgttgtactttatcagaactatcaatagaatatttatctaattcaaatattggcacatttaacaaacgcatttcatcaaatttctcttcgatgatattcgaaagttcttttttcctttcgtcgttaatgacagggattgtaaacttataacatgcttgaacaggtctatgatcactaaatgttgatttcaaacttcgataaaagatacaatgcggttcactcggataattatttttatcattaaatgacattggcgcataattatcagtaatgaaaagtttcgtttcattcatgaaatgatgcgcagcatctgtttcaaagattaacttatcttctaatccgattttaatacgtttcggtgacgtacgtattaatattcgatcagtccaagatggaacacgatgttttggtgatgtatcatagatattactatttaagtcatatttaaatgttggattaaataatattttcggctctttaaatgcattaatgattttgtcgttttgttgagtgatatgtaattgatctttctcatataaatcacttaaacttttactattgatcttatcaatgacttcttcatacgtcatggaaattcgataatttaaatcgcccatgaatatgatgtaatcggaattagtttcatatgaaacaatttcatgccattgagtgttacgttgttcccaattttgatcatgtggtgctaaatgacaacaaattgcaactaatgacatctcgccaatgttcatgcggaaaaagactgcagctttgttggctaacattccattcgcgccaagttttttggtttgtatcgatgattctttaactggaggatttaatcctttacgcactaatgcgcaacaataaacgccacccatagaatcatgtgctacaacttcatatgaatcattacttgcaatatgttgcgcttttaagatatatttagtccataactcagtgttatcactatttcctgtgacaacagacttaaatgacatgtcgatttcttctaacgcaataatgacaacatcggatggcaaagtgggcgaatgaaatactttggtcagatcatctaaaacactatcgttggcttcgttacttgcaacgttccacgtcagaaaattgaatgtaaggggaacttcatcgatgtaaaattgagtgttttgcgaaatgacccgcttctcccagatgtcacgacatgacgaactaaatgggataggactatatgctgtactatcgccaagtggttcggcattgggtggattgggaatttctgaggatccgcgtaactttcgtagatatgaaagattttcagaaacaaattgatcatctgttgtgttcataagaagtgaggttttgccaaaatgtgataccatttgttcaacatctactagcttgcggaatttgaatgttaatgtgatgtttccatagcgtgcaaattgaagtgtaaatgttttgttgacatatgaaaatgaaggaataagttcagatgtaattggtatgaaacaaaaagaattggatgagtcttcaatgtataaaaatgaagaagcaatggaacaatttagtagatgtacactaagacaaacaggcttatcgtcatgcgcaagagtagcatctgctttaaaccatacttttgttgcttgaactgcttggagcatcgctgtagaagcaattagattccttagattggaaacgttagaattttaacgtctgttcaaaagtgccaatgttctaaaaattcatctttgtttttattatagtctcaatattatgctttgtattaagttttactttatatactcaatatttttgaatgaaatgatatctcatttttattgatgttattattatttcatgctaaattacgatttttcatatttctgaataaccgattccccgtattcaatatttgtaataagccttaaaaattattattaaaatgcaaagagatttatcatctatgatttaaaaaatatcttaatatttgatttgaaaatatgtatcagttaagaaagcgaatttataccttaaaagatgtatccatattcaatttttcagcatgaaatatggaatccatggaagatatttttgagaatattaatgttaattatgaaagagcatattttttcttttttacattttatcttagcacaatcatcttttagataaaatcaataaaaaaattagaccgaacttttttatttatcagaattgaatttttttaaaaaagttaccatctctaaaatctctcgcaagttatttattttattatatattattcatatgaatttcggatgaaaatgttgaaattgtttcattttctttttcttcatttcaagattacaactaatttatttttcattacgaattaataataaaacgagtaacacaacaaaagtataaatttcatcatattccctcatatacaacaatttgtttagaaagcataaaaaacacatattatttgtgtactaaataatgaaaatctcaaattaaatgacatataaatatatttcgtatcttatattccttcaaagaaatcaatttaattaattaattccaaaccagagcacaaactgtatatccaaatatcagaaaacattgttatgactttaacgttcattacaaaacgcaaacaaagatatgacatttatttgttacttacaaatacaacaggaatcaggcccaccccggaaattgactttgccgcatcgtaaaacttatgaaaactttcgttgtactcattctgcagtttcggcactttttccattacttctcctccgtaaattgattcgattactttgttttcgttttcttcgttatccgttataatgaacaccgcttcgtaattttggcagaatttgcaaatttcagaagtttcttctctcgggaatatgtacagtattatgtctattggccgcgcgcctctaatgaacactatgtccgatattttttgatcgaatgaaatatcgtttccgaacattcgaatgttattaatgtttgttaaatttggtattaaactattgacatatcttttagagtttttgatgtcattagttaataatatatttgcagctttctttaggccaattgtccatatcgaattacttgttgaaatgtcattactaactttgacaggatatgtaaatatgcgtacaagttcagtaccttcatcattccgatataacatcgcaaattggaaatatacatattgatcttgaattgatttatccggtaattttaatatgtacgtgattccgccgttttgtggaaacgctccaaatgatgaagcgcctgaattatggatgacacaatttcctaaatgttctgtgacttcaattttatgactacatctaagtttaccgcaactcttccaataatatttttgtgtaagaacattttcgagttcaatattaaatatatttaaattagcaataatatgaaatgttccagatgtaagtcctgatgagatcgatgtgattgaggattcattatttcgttcattactagcattagtaaagatatgaacagaaatgttgtttaaatttaacttgaaacataaatcacgaaattcatcctcattatcaggatatgaaaatgtcggttgttgtctttgaagtatatctgtgggacaaccatcaacaaaagcacatagaacacagccattatcgccaattaactcattaacaaatgtaaaaagtaatttaatttttgatgcttttgatgttggcggttgcggttgtgaagtgaatgattcaaaaattgaattgtaaaatggtcgcgtttcccttaacggaggaacgttaattggtggaataggtaaattttcgagttcactaaaaactattttacgtttcttggagggatcatataatgtgatactttggttatatgtaattaaatatagacatgtatcatcactcattttttgaattatatttttaagtgaattaacaaaaacttttgcatgatcataattagaagtgtcaatagcaatcgtgaatattttcttaaatggtgcttcggttttgttatattttggaagaataacatcataaactggataatgtatttctggtgaatcaggtgtaaaaccatgaggtagtgatgaatcagtgccacaaagaggacacctccaaactttggaattatggattttgcaaagataagataaataaccatggcaaaaattacatcttacatggtagcgatttgtataatcgataacgggtatgttaggaggaccgtttggtgatatagatataccaatcggtatatttgttacattttttgaacttggaaatgaagtggttgaaatagaaaaatatggtggaagttgtggcatatcttgaacttgttcttggcgctgtggttgattatctatattttctggaaggaaatatctcctcattttttaattatttgggcgaaattaaaacaaccgcaataacggtggttatgacaataaaagtgacattgtttcacaaaaaatggtatggaaaaagtgataaacacgatcaaaatcaattgtaaatcccaaaaatttgggtgctttatgtaaacataaataaaatgcaaattttggaatatttacctggaaaattttattcataattaaacaattattacaaagacaaataagataaaataaattaaaaataaatatggtaaaatgtaaaattatttcaaaataaactttctagatccaaataatgcctaacggcaaactattttagaatgtaacaaatttatttttgtgaatttcatggtgttgcgcaagaaaattaaatgtatcttaaaaaatgattttctttttcaaaaaatctataatggtataaatcaaaaacatttcgtgtattcgaataataaaacaatattttttatttctatttgaaaacaaataaaaattatattggcattatgtggcttggaattaaggccacgtccatcgcatccattatttctttttcatgttcttttggtactggtatttctcctttcatcacatttacgaggtaccttgatgtgaacaggtctgacgtctgatagcgcggaagatcgtttgcagatttccaagaatctccgggatcatattggaatggtcgcacaaaatcagcagttacaacagcctcttcatatatggaaacagttggaaaccaaaactctgttggatttatagaatcaaagatgactcctttgtcttcaccattaataaataatttgaatgcaaaagaatcattatcaggaaatagaccaattccaatgacatctccaggtgaaaatggaggagaagggtattcctttccacagtgaaatgcacctcctttatcacgaacacaatagccatattcatcatatcctacggaactttcaatttcggcactaagtgttgaaattccaaatctaacatggctattatcattagtacgttcgaaagtcaattcaaagtaataattattaccatcaaaaggaataaaacgagtggtacgacatatcctatatccaccggaaagtgttattttgtcttttgatatgaagtggaaagaacgagatgattttaatttagaaaacttcatttgatgattaagttctggatcactaacataaggaattaattgaagagccgcgcgacgatgcacacctagatcttcgaaatgtagattttgcatataaagtttttctggtggttcgtcgctttgttccatttttcgttttctaaacgttctttctctgaatttttgagaacttaaaccccagaattttcagcaaacatgtccgatcctctcaaaatggccaaagtacaattttcacatgacgaaataaaaagtttttttaaaccttgcgaaccacttgtagataaaaaactatttggtcctgcttattcagatgaattgcaaacaccaatagatttatcaaattttaaacaaaaaatatgtacattttatcaaagacctataaagcaaaggccacgatatccaaatcgggcaaaaaattatcaaaatgaaaatcttgaaaacgaaaattttattccccaatttgttcctcaagaagattttcaagaagaatcatttccacaaattgtacaagatgaatacgactctcaagaagttcctgaatatgtttttccttcaacgttacataatgatcattttcaaaatacccaagaaaaatcattttcttcaaccaccaacgatgactatcaatcgcaggacactcacgaaaattcatttccttcagcaattaacaataattatcaaccagtagagttacccaaaaactcatttccttcgtcaactaccaatgaccatcatccaccaggatttgaaattccacaaagcatccaaatcatgggatatccacctggtttttatccagagccagtcatcaattttttaccaactgttatagcgccaattgaagcccctcaattccaatatccgctcattggtgttccagttgctacagcgccattacaaaccgtaacacaagcgccagtatttgagtttgagtttaaaccagaaccgttaaatgaagaagaaacgaagcaaacagccaaaaaagttgaagaagaagaagaaatagaagaagaatatgaagaagaggaagaaatagaagaagttccacaaaagattaaacccggtcataaaacaataccaacaccaaagcaaatagtaaagacaccaattcataattttgttagtgcagacagcaaaaatatatcacatagaacagggcctccttcgcctgacggatttgcatctattagtgagtatagagcacttgtgaatagctcacaaaaaaagaaatcatttcccaaaattattgttactgaagagaaaaatcataaaagttcaaagctaaaagttaataatgatttatttccacaagttcttgaagaagaaaatgaagaacaaaaagatgttaataatggactaacaaaaacttcatttgcacaaatgttcgaagaagaagaaaaacgcgcaaaagttaacaaaacgccaactgatagttacagcagtaaacacttaacaaattcatttgcacaaattcttgaagctgaagaaaagcgcgcaaaaaatcatcaaacagaaacaaaagttaacactcaaccaaataaaaattcattcgctcaaatgctcgaagcagaagaaaaacgcacaaaagttaacaaagctacgaacaataatcagaagaatacttcgttctcacaaatgctcgcagctgaagaaaagcgcgcaaaaggaaataaatcgaaaatgaattcaacagatggaaaacttaagtcgcataatggaccgcgcaaaaaggcaaaacctgttgtaatgtctcttcaagagttcatacgtgagcagaatcaaccaaataaatagtgttcatttcataattagtaaaatttatagaagagtgattcagttgtaattttgtaatgattttgaaaattcttctcattcaattaaaatatcgaaaaaagatttttgggttttattagttgaagaaataattaaaatttttacttgaggcttcagaaccatatataaagttttaatcaagagctaattaatatttattttatgtaatatcaaatattatctaaacagcaaaaacaagcaaaaagatgaaccaaagatacaaaagaagattgaaaaaaaagaatcttcaatagaatcttattttagtgaacttttttatattttattaaaaattcatgatcaaagtttgaatttaatatatgttattattttatgaagataaataaacttttttcaccacaatcatgtaaaagcatgtatacatgtataaattgcaggcattattgtgcttgataaaaaattcattttcaaattaaagcttatagacaaaactgaaacaatatgataggaatcgagttgtaagaaaaaaatggggaaaatgagatattcacgtcaaaatcacgtttatgagagaaaccattaaaaatgtttttttccacttaatgaagtttcttatacattgaatcagagaaagagttcttcattctttcgtataactctgacgccgatgtcttcaatttttcaggtgcttcaacaaaacaaatgaacaaagtgtcagtcataccttcgaatgggaagtcgactatcaaaaatattgaaaatgtaaagaacagcgcgaacatgcatgaggttgcgaacacccaatcatatacatcatccatcgcatatccgataccgaaacctacggctaaacctgctaatgtgaatacgatcaaatgcaacgtcttacttaatgagattattgaaccttcgaataacacatcagcgaatttgttacaagacaattccataaaacgtctgcaaccttctctaaatggcacgccgaacaatgagcaatatattaatgcataacgattgatccactgaagacaacattcaataatgcataagatacataacgcaatgagccgaaggatagcgaggtattggttgttgttgtcattcagattgataactgcgcgacatgcttgagcaattgcaagccaaaatgcggcgcacgcttcgctgccgaatgaagtggtcattgcgcgcttgaaggattcccatacgggggactcgggcatgtattccgtgtcgttcaggaagtaccacgttcctgctacaccagatgcagttgcgtagatgacgtatgcgaatgtatatgaaatccaatagtaagataagactaagtaaatatataacacattgttaagatacttgtaatggatggagaagatcatcatcgaaaaaatgcaagtgataataatgtcgaaaatgactacaatgaagatgtataagaagatggatgggttacgaagcaaaattagacacgtttgctttaatacggcaatagaaaactcaatgcggtcacgtgtgcaacataaacaaatcaataaaaaaattattgcgggatataaaaacagaacataaaagcaaaagagaaatgatggaactagaatgacaacaactgaaataacaatacagataaagaaaccaaaacgaatataaacgcttggaaggtcatataaagaagatgggcaatgttaatgacaacaccaatcgcaattccgatgaataaaactttgatctcatctatatcaaagaatgattcaaatattctggatatactttcagtagatccatattcgttcttggcgataagaatataataaaagtaagcaaaagtggcaacaagactcaattgaggacgaataatatcacaaagaatagatcgttgcatttggtttctttcttaacattttgtgagtaattttgtggctcaaaggcttgttggttttcccaataacatgaataagctgtttgatcacatggaattgtggcccattgctcaacttgcatttcgtgatattggatgtggttaggatcatagtgatagtttgctgtttgtggttgataattgtatgaattaggttgataatacccttgttggtattgttttggatcaatgtatgcttgtggctgatatgaaggatatggtggaacatattgtggagtggcttgcatgcttggatgaatataagcttgaggtggataatcctgaggtgggtgcggttgcaggtaagcatgttgctgttcaagaggtatcgatgctttatacatttgatcagacaaatgtttttgaatacaactaatttgaatggtattgttattattataattattgtaataatagttattattgcaatattaatatttcttgctatatttattatttataaacgaaacaaacataaaaatgaagaaaatgcaataattaatgaagcgaatgacaatacgataaaggattttttgttcatattcaaatatcaaacaatgcctaatatccatttgtattataaaaatatattttattaactttttgattttgcttttttaatattttaatatgaaattgaggttgaattgaagtacaattagaaatgcgaatgtgatttatgtttttgatgcatttatagaaattggaaatcatgaatttcttttaaggaagaaaggtcgttattattgaagagagtatgaaattgtttaaccgaaaataatttttattcttcaacatgtaagcccattttaaatgtacttccatctttattttgtatctcaagttctttcggttccaataatttccactcataccacacataatcctcatttccctttctttcaatttccaattttattacatcatctggaaaaactttaatttgctcatgaagcggcaaatatattgggtaccaactactaaaaccatttgcttcatcttcgagtggcgaaattgatattttcacatcatcgaataattctgcttcaaaccaaccaccgaatccgcacaacattccctcataatttacacaaaactcgataacttttttcatatataactcaccacaatttggatgatgaaactcaaaacattttttacattcagataaaaaaatacatttcgataaaggtataatacacatttgatcgaacattttttctgatttcgcataactccacataaaattcgacattaaaggtactaagaatgatgtatatttcattggtattgatatcgcatttggacttaaaaatcgttcgcagccgattaaacattcaggtgataattcattatctccaaacccgcccaataattcactcaccaatatctcgactttcttatcaacgttaacagttcgcatatcgccttctatgacttcaactgtttcaggccattcttgttctttccttaattggagtaatcgcgcagcaattggattcttttcaatagctatgatatgtttagcacctgctgataatgcagaatcaacaattggaccacgacctgctcctacaatagctataagtggtgaatgatcgaatttgtgaagtgacttcgatatggcggttttgtaaagtgaatatttgattttatcagattcgaaagattcgtaatgagtggatgttaattgttgttgaagtggttgaagaaaacattgaagtttagtaagatatgggttgggtgggttcttaagaaaaagatcacagaaatgatgataaagttgaagatcttcattactaattggaaattgaaatgtaaaaataaaagaagtgttaaggtacatatgtgataatagttcatattcacatgatagtttaatggataaatcagatgaaaaaacatttttggaattaatcacaaaatatggtgagttgacagtacgccaaattggattgaatgtggaagggcaaatacctaaatttgttacgttgtcgcataaatttgctagttcgatataaagtgaatagtcatcacaaattgcacaataaataatctctttgtcacttaaacgtggcttaaggatgtcggcaaatttgttgacattaaatttatctaaagtaaataagcgaattgaaaatcttaaataatcactaagttggattgattctttattattcaagtcaacgattattgctgatccttcaagtctgctacaatatcttaaaaattcgcaatttaaattttttagaatattctgatatttaaaaactggtccgaaaaaaatttttttatgttgaaatatactatagttttgaatgtaatcatttatatcatcatatattacatatacttttgggagtgtcaacatgtagattttagggtgtcttgtgctgcaaccggttaaaagtgacataaaaagattttacaaaaagtgtcattgcccacaataaaaacgatcaataaactgatcaatttttcatcgtaaattattcaattctgcgtcgaaatgaacaaatgtaatcaatcactttactcgtcattatacaagtgtgtaaaaacatttcaacgaaaaataataatatatttttactcaatccgatattaaataataatcaaatcttcatccgcagttatatctcttgtttgtacagagtaaaatgcaattggctgacccaaagtttcttccaaatgatttctacaaatatcttcgcactcggcttcgcaacccgcttcaacaatgatcattttggtcgacaaataatttctcgagattgcatagttcaccaaacattgatatattctattcttctcttttctgaattgacttttacccgaatttattccgccatttttcagtgttattgttgtgataatattatacattgttttatcttcaatttcgagattaatttcgaacttgccaacaggtgttaagaaccgataatcgaatcttttacccattttatattcgactacatatacacatgagtaaggaaaataaattgtgttcgcttcataactcttttcacatgatgttaatataatataatcatttgttaatattaatttaaggatttggtcacgcgcaaatggtattaatcgaggtaaataataatcatttccataaaatcgtttataaacttgcaaaaagtttgattgaaatatatgtttcgtaaatgatcgaacacttttaactttaactgttgtaatatataatacactactagtattttgatttaatatttgtgtaatgattttggtttcggttaagttgacgatagagtttacaaggaggacgtttatttttctgaggacttgatcggcttttatgaattggtcgttaacgttcaccttaattgaactaattatacgtaaatcatccaaatctttatttgaatacttgcagagttcgtttaagaaaaatgaacaataatttaaccaatgaataggataaaatactaaaagcaaattatttaacaaaggtaccacagaagaaattgaattattgttatttgacattaaatattgtgttacttctttatttaaagtatgttcaattatatcaattatttttgcttgtataaaatcgacatattcactataatcaattgtattaaatatatgtaacaaatgatgtaaagaatttgcaaagtttaattcatttaatgatttctttgttaaagtttcattaataaataatattcgattaaccacatttaacacaaaatcccatgaaaaaggcgctttaatagtacaaagaccttttaatatgtttaatgattctttcgatttcgcagtaatttccaatatacatttaaagaagaattgtcttttccaaaagttaaataaaaattctttacattcgttatcagttgataaagcaaatggttgatctttaggtttaaagtcgaccaaattaaatggcacttttaataatgttttaatagcattaatgttatttgatttagcagcataatgtaatggatataatccttgtgcatcttgtaaattaacattagcgttatgttttaataaatattttattatcgaagtattacctttaattgctgcataatgtaatggtgttaatccattcttatcactcgaatttattatatatccatttttaataagttttttaatttcagttaaattgttttcatttacatatgttattaaagaattctcgattccatatgaatgtaattgtgatatacaattttgatgattattttctattgcataacttattggtgttctatcatatttatttttagcatttaatatatctttatatgtgggatctaatgtttttaaatataatgttaatatttgtattgatccttctttacagattaaatgaaatggattattaccttcttcgtttacatcgattaatgaaacatttgaattctttatgattttctctataattgaaatcattgaatcattaatcatataatgtaatactgtattacctttattatctttttgacttattacgaaattatcagtaatcaaatattcagctgtattataattatttgaaattgcggaataatgtaatggcgttcgacctaatgaatctttcgaacttaagaaatcatgattttgttcaattatttttgtaattaatgatgaacttccgatagctgctaaatgtaatactgtaatattttcaactttttcatcatcgaaatattgtaatgattcaataaatttatcaaatttcggatttataagatttaatattggacaatttgttttcaaaaatggaatttctttatttggtaaattatgttctttaaataaatttttagcaattttgaaatcaattgttaataaatgtttcgaatgttttattaacataacattttcttcaggattaatagaataacttaatgaaaatggtgtaaacccacaattacatgcaagatcattatctgaatgtttaaggatattaattgattctgtatttcctgataatactgcatacataagtggtatcattccattattatctttttcattgattaataatttggattgtgaaagtacttctttaagtaataaaatatgtccacttgctgctgaataatgtaatgctgttgcaccacgtgaatccttatgtttaatatcacatttttgggattgtactaataacaatgcttcttcaaacatatttcgcttaattaaatgaatcaataaattgtcaccatcttcatcactatatgatggcgatgtgacacgcttaacaagattaaaggttatttggttattccctaaatctgctgctaaaaaagcagcttttgttgtttgctcttcagaggcgaacgtttgtatcgtttcaacggtttttgcggattttgatgtgactgcaacttcaagtggagaaagtccatcagaatcaagagcatttgtagataaaccagaaagaattaagtaatgacaaatagagtaataacctttagatgctgctacatgaagtgcagtataattttttggaccagcagtaagatttaaatttttggaggcagtggattgatgagattcaacaaggtatgtaacagctaataggttttgtgataaaacagctgaatgtaatgaaggcaatgctccatattgtactagtaattcagcaatttcattatgacctgaaataatagcaagatcatatggagaagtaaatttaagtcttctgtggttaagaaaaacattagattctgcaccaagaattaaatcatcaacggagttgatcttgttttccaaaagaaaacgaaccgcatcaatttgtccataataaattgcaaagtgaagcgcactccatccttgtgtagaataatcatgaaatatttttaatgatgtttgataaagacgaagaagattaacatcacctcgttgagctgcaatatgagctggtgtgattttttttatgttttggaaatgagtttttggaaaatgatttacaacaaattgagtaacttctctagcagaagcccatgctgcataatgtagaacagtgttcccgaagtaatcagtgattaacattgctttttcccctgcttttgccaatacaataattaatgggtcaagatcatttgttgacgcccaatgatgaagtatagttgcacctgtttctggaactatttttaaatctgcgaggtttaattcttcttcagatggaacattgggttttttggtatgagttgacatttgggggtgtctaaattatagaaaataaagttcttaatattttcttgcaagaaacatattgaaaaacacatatttatcttttatttcatccatagtgcatgaaaatatatataatttataaatttgaaaaatttaatagaatttttttctattttgttgaattattatcgcagtatttatattttaaataatgtattatccatttttttacagttttgtcaaaacaatgaacatttttaattcaatctaataacgaaatctgtataaattataacatttgatcgaataatattaaatatataattgatagtcaaatcagtaattataaatatattttcattgatcaattcataatcgagaaaaatacattttttttgatttttttaattttcaatagaccattcagaatttcaattcaaaaaataccaacacaaatcattttgacagccattcaaagtcaaaataactgtctgaaagcaaaccgacattttatgttcatttttttgaaccattaaaaccgatcaaaaccgccaccgttaattcaataaattatttcataaacttttatacaaatattaattaaagtatttcatatctataatcgacaacatctccttcaccgggtcacaaatctccattggagtgaatgggattatctgtgcctcgtttaaagaattcaagaaactataatcgacgttttcatccaaaggttcttttgtttccaaatcaaattcttccacatcttccatatcatcttgtttaaattcttcgttagggatttcaaacaaatctgttctcggtgtttcactttgtaacatggaaaacaaagagcattccaacacattattattttgttgttgctttacgccccttaacggcttcgccggttttcccggttttttcttaattttcacttcactttccatttttttcttctttttcttgttatttctttccacttgtcttatagctgcagtttcatctctttcttctcgcgaaggtcttgtatgtttttgaggcgaagacttttcttcttttttctcgttattatttggcatgacttcaggctcttgaatatcaatttcattaaatcgccaattcataaattgttgcggctcttcaattgttgccggcgcgaaatcgattggaagtaataattcggtgtttggaagtatcgaaaacttttctcttcttgtccgcttcgatataccatttacatctgatattcctgcgaatactccaacgtatgtaactccatcgcatttgaacaacttcacaacgcaatttgggcataaactacgtcgaaagttatgtatgaattgcggattgtttttacttgtgtcaatgactaagtttgtgccgcatatggaatatatacgatgatcaacgccattatcataacaaaattcatcaatggtgccaacaaatccttcaacaactgctataagttgttcgccttgtaatggcgattgacaatataatttaccatttcgaacttgcacatctgatggtaatgtaacttgtagaatctctgtaatatgtttaagtttttcaagttcgattttcgccggatcactacaatcaaatggtgacattgtacatgtataaagtgttgtcggtaattcatacggatgatagatatcatatttggctaataaatcaaagagataaacagaagtctcttggttaatcccatataaaaattgtaaaatataaaaaacggatcgaaagaatgaaaatgaaacatctccacgacgtttctttaacgaattaaatatgattaatggatgcgtaagataaaaaaatgaacgcatcctgttatatatggtttcaacaaattggaataaactaatgtcatgatctaagaagtcgaccgttaagatgttgatgtagggaaccgttaaaatcgacgggtgcatttcgttgataactttctgtgaaatatgaacaacaggattatcaatggggagtgcaaatggtaaatgaacatctggtggttgtgatggtgttccgccacatttataacaaacatgatttttggtataatatggaccagaatcaagaccttcacatttcttatgaacccaataaccacatttggaacattgaataagaggataacggtaattaagattatcttcacacgaacatcgaatgtgtttgttagaacaaataggacagatgtatttgttaggcatggtgttttggttgatgttaacacatgctgcatgttgccaatttaaacatttttcacattgaatcataaaaccatgttcatttcgaatattacaaaaacaccgtagattccatggttcagaatcgccaccttgttgtactaatacttgtggaagtggacattgaaattttgtattaaattttggaatttttggtcgtcgtgttgtaacaattttatttttgctagaacttggattactagtcagaaggcgcttaatattgaaatattgagaagttttatgagtaaaaagatctttaaaatcaactggtggaagtttagggccagaacctaaatcaatattttggctccatacttgatgctcatcttcttctacaagtgagatttgtgggttgtctgtcccaggtggagcaccagacatttaaaccacttaaaaagtgacataaactgtttctttgtgggtatgtgaacgtttaaaaataacaacaaaaaagttgtgcaaaactgaatgataaatacttttacgtgatttaagacatagccatgaataatctggaaagaattaagggaaatggtatgtttatggtttattttaaaagagcgatgttttcttcataatatgaacaaattcttcatatgaaacttcaccgtcaccatcgcggtctgcttcttgtatcatttctctgagttcttcatcggtaagattttcaccaagttcaatactaacacgctttaaattcttgaatgtaattttcccagtgttgtcatcatcaaaaagcctgaatgctttccgaatttcatcttctggatttctttcttgcattttctttgtcatcatttgtaaaaattgtgcaaagctaattgatccagttttttcagtatcaacatcattgatcatacgacggatttcttcttttgttggatcaaagccaagagctttcattgcaacttttaattctttagcatcaattgatccacttccatctgtgtcgaaaagatcaaatgcctcacgtatttcttggcggtgttcctctgaaagttcttcccttgctttcacatcagtttttgtttgtgccattttaataaaataaacgtacacccacaatttttcttgcacaaaaaatccttataaatcacagagataatgataatagcccataactctgagaatcatttaagcagtcaaacagtattttgttataatttgtttaacgctacaaaattttaaaatcataattcatattattctttaattttcaaacatttagtgtagtaatatgtaagaggaacgtccttctatttgtgttttattttccttcgttaaagtgtttgaaaatgtttttggtgcttttggcaaaagataacaaggcaccataaaagggcccataattttcaattgaattttggcctttcgcaagcagtatttatattgaaaaagtgattcagcttttggctttattgacttttgtttgagcatatcggcatttaaatactttatagtttacgttctatcaacaatttgaactgaggtctggcaaagatcgaagtaaaatagccaaaattcatacgaaaattgaaataaatctgtgcgtttagcaaaagctaacatggtctcgacaagcaattcattgaataaggactggattcatgggattcctactcccgatgaattcatggacgaaaatgattgctctatccatgacatgtactgcccaaggtatggttctattaatgatgctgagcgtattatgacccatgaccagcttgctgagataatgaaggacacaagcttacacagagctttcaagcgttacttaattttagatgttagatttttttatgaatatgaaggagggcatattctaggtgcaagacatataagaaataggtctgaactcatcagcctttacaattcttttaaggacgtagcaaatgaaacagcagttataatacattgcgaatattcacaagaaagaggaccaaaagttttttcaatattccttgagcatgaccgtaatcagaatcttcaggtttaccccaataagacatacccatacatatttttactccaaggcggatataaaacattttgggaaaatcatccagatttatgtcggggtgattacgtaccaatgcatcaacgagaacacgttgaaaacaaagacattcaaagatgttattcatatttcaggaaatatatgttacaagaacaaaattatgtcaaaaggtccaaatccgcaataatgagtcagagccctttctttcttgattttcccttagatccgaacgagtttaattcttgttctggaatgatttcaagccaaccggtttgaattaatgaagctagtttcaataaatttttttaattagcttccaatttaaacacaattaaatacttttgagctaatgaaattattcgaaatttgtttgttattgaaaaaacggttgtattggatgtgaagtgatttggcggttatggcatttttgatgggctttggacgtttataattttatcggtcgacagcgttttctataattttattgccatacatcgggaacatactttgacctgataaaaagtgctatttcctatgcagcaaccaaaatttgaaaacgacgcagttcgtacaattacagaacaagctatccaggaatgccttaagaatcaagtttacgatcactctgctgtaaacaagtggtcgagtgatatattggaaaatacacttcgtgctctttgcgagcgtttccaatcttacaaatttgtctctcaatgccttattttgcaaaaagctggtggtggtcttcatgtttcttcatcatgctattgggatagcaatagtgatggaatggtaacagttcgttgggaaaatgaatcaatgcactgcatcgtatccatttatggacttgcagttcaataaaaagttgacatttttttttttggaatcataatattcttttcattgttttaatgtgtttttgcattgaatatcttcaaaaatctgctaaagtggaaggaatatgcattaagtaatttagaaaaaaacaaaacctgcgaataaaaactattgtgaaatcaaaaagcaaaaaaaaaatttgattttcttgcaaactttaacagaaatttgtattagaaaccgatcaaaatcatttcaaatcaaatgatcacccgccataaatatttgcacgtttaaaatatgctggagttaatcgaatcgaatcgaagcttcacttgctaaaggtaagtaattatttattcgcgaattcattttacctttcaaacgacatcgtgtgttgcacctttctcaaaaaaatttaaatatttcattacaaaattaacttatccaaccaatgactttgtgctaagatgaaatacgtacgacttcacctttctcactttttgaaatggtcttattgaatttattatatgagctaatacaaaaacctcccccacccaacttttagaacgattcatacaacagggcactctaagattttaaccgataacactttttgatggttagaaatatttcatttttatttataaagtcatcaaagccttgctctatagcaggaaaggagtcttctggaaatatttccagagcacaaaaaggatctctataatcatcacatatagaaggatctattggcttttctgtaatcgaaggtttaggatcttggatctttaatggtgtaataaagctttgcttatgaatagcattcaaaggttgattttgatcaggtttgattaacctttggaaaatcttttttcgtcatcgtatgatatatatttagctcgaatatgaaatttaggcatacctgttcgatatggtattttggacataaataaataaaaatgaactaatgtggtaagtcattaaaaattaaaaatgacaccatgaaaaataacaccgatgtcaattcgctggtatgtttctgtttgggtttgacgtacctcatagaatttcttaatactttacatgtgtaaattaatgttaatgtaacatttacagtaaatttcctcacaaaaaattatgggcaatcgcttaataacacgcgactttttctgaggaaatttgaatgctttattcccacttttgggtacatccatgagaaaaggaaaaataacacgccactttttgtgtgatttattttggcattaaagcaagtcatctcgtagcattttcaaatgaaaacatggtgaaacattcatttgtgaacgcaacggcgactttttaaaaaggagaatttggaattccaacagtttacgaaggattctcgaatatgcttattctcacatgatttatgatgttcttttctcatgaactgttaaactgtatattcacatttttgatattatgagtataatatattaagtttttattaagtagctaaaacattttttggacatctaggtgcagtatgagtatcacctccacatatactgcaacgatatttcttcttcacttttggagcgtttgctttatccacattgtttcttggatatcttgaaggcgctccagaaatctgtatgtgttctggtggaagaatatctccatcttctcctgtttcatgttcaagcgagcataaatcatttaaggctttgtctagaatatttctaatttcagaagatcgattcgcgagggagaaaaaacgttcaaatttatcaatgcaattactgtaactccaattgttttctttgttttttggccgtaaatatctttcaatggtattgggattatctgttttattttcgttagtgattatcaatctacaaggtatgtcattgattgttaagagtgggttcttatcttctttaattctcattagaataaggtgtttacaagggagattgtataatgtatgatttttgcagcaggtctcagagtatggaatagacaatacaccatttagtttgaggtccatatattcagagaatatcattgctgaagcaaatgtaccgagttttttcgaatcttctttgctcattaattcttgtaagataattgttggtttatcacttttagataatattctatatttttcacctcttaaataaattgcatatacaagatatcctaatgttacaatcatatgttctagtaaattcttgagacttccaaaaaaaccttcaactcgatttgatgttgtattatcgcaatgtatatattttgaaattatacttggtagccacttatcctgatcctctaataagttttgtaacaaacgcgatccttttgtttttggatgttcatttacataattattacatgcattgataaattcttcttcagaaatttcttggatttgtagcttatgaaataaatcacacatttcttgccctgccttctgtcgaagattacgagaaatgtgaacactgcaaaatataattttgcaaaatggaaagacaaatttcagtgctttgacctgtgttttgtttcgatcgcagataaagagcctgatatcacctattttttgtttgatttctacaaaataatttataaattcattttttgttcgtgagcatattattgcaaaagataatacttggtttcgaccattttgatcttcactaatcattaataaataagggaggtgatagtaatttgtacaacttgtatcgtcaataatgcacagatcattagcatatttttcagacataataggttcgtgaaatacataacatccattaaaacgcttattttcatctatttttgttcgaccaattatttccatttttcatttgatcaagcaattcatccatttcatggtctcgaatgttttttaagatttttctttctgtattgtataatacatctttcgaacaaaccaatccttgtttgatgcgaatgttataagccgataatccttgtaatgttgaatctctgattttcgttttttgtgtttcgcttagttgatttctttcttttccgttgtatgatgcagaaatttcatgtgtgtggtttaaatcgcaagaatcgaattgtgctaattgtgtttcggggttgtaaagaatcctaaggcatgcattgcagttatagattgttcgatactgtctacagcagaaaagttgcattgatcttgattcacctgttgatctaggaacatatcggcacttatattgatcagaaatctcgcgcacccgttgaacaagagcatgtacatcttcaaagaatgcattgtcaagacgagtaaatgcttctatgagctcaggaggagtctccattgcactgatttggatgaaacatgataaatcacacaaaaagtggggtgttatttttctcttttctcatggatgtacccaaaagtgggaataaagcattcaaatttcctcagaaaaagtcgcgtgttattaagcgattctccaaaaattattcactaaaatctctatcgaggaggtttttggcagaaaaagtgggaaatgtccagacgttcacttttgcttgctttacatactatcgtcaggagaaaatgatggctttttgaatgattttgatcggtaactgaatttaattaaacataaatatcttggaggaaaattataaccaacaaataaaatatggcctaatcaactttattattattattttattattttaaattaaaattcagtaagtttgagaataaattacaaatatctcgaaattaatcaattaattcaaattcatgatcacaacacaattgtaaatgtaatatcttcatatcagtctcgcaaaaatataatatcatttatttttttcttcataaattccttcacttcagaaacaccacccaatatatcttatatgattatttaaaatcaaactaaaaaaaaaaataaatatacatttgtcttgagtttatcatcagattcatcatggtttcatttctctgtgttttttcatatagcctcttataaaggtaattgtaaatcaaaaaatttattaaatcaatcaaaattaattccattctggtaattcccaatagcattactataattcagtatttattttcaatacaataataataataaatataacaaagttatttaaaacaatgatataaatattctttttattattaaatggcttttggttttattttcttgagttcttgataaaaaaaggcatagtaaaaactttttgaaaaatttacaaaaagcacttttatgttaacatcgttgatatggagcgccccaatttgacggttttgttaaaatgggaaattctcaatcatttaatgaacaagagtcagatgacaagattcgaagtaactcttcttactttggagacaatgggaactttgatgatatggatgctaatgaaatagcagcagcaattcaacaacttcaagttgaaagaatgaggaaatacaacaataaaaatactaaccctccaccacaaagaagcacacaacttaaaacagtaatttctgtttctagtccagatccatatatcaaaaactttaatggaaatgatttcctttgcttcggaatcaaaactgaagctccttgcaaaattgttgttgttgcaaatgggcatataaattcttttcgaataccagttttagatcgtactgagttttcaattccgatccctgaatattcaagttttgatgttgaaattacaccaaatcttaaaagtgtccaatccaaacccgggtttgctattgtttcaaaacatattcttaatttcagattattaaatgatgaagatgaaatgtgtttcaactttgcccagcaacaacttatcgccaaccagcaaatatacaacataacagttgggaaacggtgcagagtggaaaatagtgatgtaacagggaaatgttgcatatgtctgaaaaatgatgcgactgttgcaatcgcaccttgtggccataatgtcctctgtgatgattgcctggagtcaaggcaagccaagcttcatcactgtccatattgtaattctttgtcatcattctaaaggtgatattaatttttaatttttttttcaactaattaatctcatcaaaaatcactttttaaacgtttctatagttccttctacaatgctgcaattacaaatatacatctatgagaaagaattatatatagcagaagtgaacgcaaagaagatttattccattacattaatatatcattagaaagaacaaagaaattatcattttataactgtttcagagaacataaaaatcatgtatctgcattggataaataaaatacaaaaaatctccaaaagcttgataaaaacaccaacctaaattgtattacttagctttttcttgtgttttttatctatatagataatcagtttatcatctcataaatttgtttcaacatcgccaagcttaatctcgctgtgaattgtagcacacattcctctctgtgaattgtagcactcattcctctctgtgaattgtagcactcattcctctctgtgaattgtagcactcattcctctctgtgaattgtagcactcattcctctctgtgaattgtagcactcattcctctctgtgaattgtagcactcattcctctctgtgaattgtagcactcattcctctctgtgaattgtagcactcattcctctctgtgaattgtagcactcattcctcgctgtgagcttgttctgtctatcttcatgaagcactgcaatttataattataaactgtacacaatccgcgaaatgtaactcatccgccgacgacatccgaaacgacgcaaattatcaaattcgtttatctgcaacaaaaacaaaaacaaaatttacgaaagtgtttaattcatattcgacttttcacacaaatcggtgaacatattattattatctgcttcttcaatgttcctttggaccactgaatgtttcagcacgttgccaataatcaaatgttaacacacctaaaaaatgctttcgaattcggatgcttcgaattcatatgtttcgtttttgttattctcgagcacgaaagtatcctcttcatcgatgaaatatgaattaatctgaaaaaaattttctttttctacgtttaaaaacctctttaaaacgttatcaaacacgaacataaaattaccaataaacaaatcatcgaatgaatatttgttcgtcagcgcattataactcattaaatatgttccgatttcatattgatttttgatcagaacaataaattcgccgggaactaatgacaaacaaactatgtaatccccaacatccatagtcttcaataatgcttttgatggactttcgccataacttaatcggaagttgatggaattgatttcttgaatgttttgtgccgaattttcaataaatccaaagtacgaacaaaaccgataatagttatcaatgccaaagaattcacttttgtcatcgccgctcattaatttgaagatatttttggtctcattcgtaatatcttcatccgttttgaatatattagtgacaacttcatcatatgtaattcctttagatgaattaaaatttgtttcccattcagtttggactttattaaagaaaatcttcttccattcattcgtttgtttgagagttaatgaatatatatttatgtttaaagatgaaattggtatgcttttggctaatattgttgtttcattgatttctttgatgatattatatggttgataattatcagcacatatcttatgacgaatattccaccgcctcttatctgaaagttgaatttctttgttgttttgaaatgctgatgtttcttcttttgagacttgatatcctattgcagttaaatttttgttaatggaatttggcttgatccgtaagaaagatcctaacataaatgaattaactaagattatatctggttcttgataacaccgaataccaatttgttgaaaatcataattatgattttttacaaattctaataaaatttccattttccttttaaacggcattttgttccttgctgtcgcgactgtcttccttaggtcttcgattgttttcggcaacataaagaaaatggcactttcgtttgatgcgctggtttgatgttataaaaacaaattcaaacttttgtgaactttatatttgacatgatcaaaataaattcaaaatgtggtgtgataaaaggaggacgttaaaatggagaaaagttccattttataataaaaaataatttgggctaacaaatggtattcttcacaccgaataaaatatttatgcataaataattttttaagtattttagatttaattttttcaaaacaatcatcgaatattcataacttgtgaacgtattatcgtcattttaaggaattaatgcttttcgaaagagttgatgggatattaatatttgatatttaattcatcgtttgtgagaaaaagcagtaaagctttcttttaataaaaataaagctttgaatttgtaaatcacacaaatttcactatgaacgttttttccataaaagctttatttctgtcaaaatttgtcagggattggagctccgattttattattgcaaaatgagcatattccatgtgcgaaaataattataatctgaaagccttctgtcaaactcacctaaattgcacataaggtgctcatcataatggaacaaatttgctagaaacgaaaatgtttgttttatgattacagtttaaagtctctcaaaatgttggaaaacaactattcaatctgttttttgtttttcttctcttgaggtcaaaaattatgattatcaaattatgtaacaagggaaatttttttaaaaacgtcttgcattaaattgtattgtgaagaattttatcaaaaaaaagtagtttcttcatgaagtcagttcctgtaataaggtgatcacaagcattttgagaggttactttttaaaagaaccatactcaattatttttgttcaattcaatataacacaaacaaaattgaaagaccaatttttgagttcataaaaatcggtttttgtttctggttaaattttagaaatgcacgacaaaaaagagatctcccacggcatcaaactaagcaaatttagaaattattcatttgataccttcctccagcagacgccctttactccgatcaatgaacacccaacaagaaagcatattggtttaacacgaacaaaaaaaatatcacgtgaacaaataagttttccatcttttttacaagctcaacgaccttcctcacagacattatcaaaatccgatgaagaacttaacaataagtataataaaatcaaatcaatagcacaagatcatccaacaaaaaaggaagacagactattttcagaaatatcagaaatacaaactagcatagaatcaatcttaaatgaaagaaaaaagtttcaagaagatcataaggcctggatcgaaaaaagaaaaagaataatagcagatgtatataaagatgcatctttttactcacgtgctgatgaaacaggtccaaaacttttatttccgatcaattgaattgatctcttcaagaagattcactttgcagtgttgttaatacatttttttttcaaactatgtagtgtgaataaaataatcttttctttcacccttttttttctgttagtaccaaaggtatttgtgttgaaggcgaaacttactttttgtgtttatcggtggtagatcgcccatcaaaaagttgttttatgtccaggtaattgagagaaaataaaattttgtaaaaattgagtgtttttaaagtgacatgtatatttgctctcatcataattaagaggaaacggccgtttaaatttttctggtaattttaatcgtaaaagaattcgaacaaacattatcaattaatattaatgaacaggacatctgaattctttagttatttaaagcaaatcccacctagaaacgatgtccgttcacccccatctagtaagccatctaaattttcaatttctgctcgtgatattaaatctcgacttttatatgcaactgattcaatagaaacacttcgttctttaatgaaaaatggtaacgtacttaaccaagatgaaacgcaaatacaggaattaatttttaatttgaatgaggacattcgaacaattaatcaaaaaattcaagagttagaacaaataaaaccacagccacaatatgcctataacatagcacaaagtcttcggcgtgttcttgccacaatcactgaagattttaaagcagctattcaagaaagaagcgaagctatccagaaaatcaaacaaagaagacaaaactttggagtttctacatcaccaaaatcatattccactacatattctgttgataatgatgaagttgaaattcctatgcaaagcacaatgatggagaaacagcaacgagagcgttatgatatggtcaggaatgttgagcaagcgataaatgagatatctcagatgtttgtgaggttatctgagattatcgcatcacaagattatgaagtgtttcgaatcgaccaaaacacagaagaagcgctcagtaacatccgggaaggccagaaccagcttgtaaagtattatgaaaagataaaaggaaacaagtgtttgatgctgaaaatttttgcagtgttaatagttttctcattagtgtttatattaattatttaaagtaaatttttgttaaaaaataaatatttgttttgagagtgatcgcataataataaatgtttaaaaaaaaatttttttattaaatattatattaaaatcaagaagatttagactaaaatgttaaagtttctcaaggaaacaaatataatacagaaaatattttgatgtttttaatcaataattttatttatatcataaatagaagtgattgtttgtccatgaaacataaaagaaatccaaactttcattgttaaattttcaacgccttgattcattaaaagaagaacttgctgaattggagattctccataaggcagaagtatattacttgatggagcttgtgcttttaaattccacccatttggaacagcatattttgcactaaattctggtaatgaaatcttggatttactaaagaaagatgttctaatagcaatttgtctattatcattttcatttttctggatttcaaaaaataatataaaatctgatgtttgaatgacttcaatagatccacgaggtggagtaatattgatatctatgtcagttttactttgatatgttacaggctgtgtaatatttctttttctaatttgatcattctctctttcaaaatcaacgagtttagcattatcatttgtgttttgtgtatatgacttagacctaattctagaaggtgaacttgttccaatttgtttcattggacaataaatatttaatgaatttcctgattttaaaattctaattatttctcctgctctttgttgaacttctatacgatgatcaccacaaaattttccaataacgttaataattttattaattaaatcaaatttaatggcaatttttgcaattgatgataaaagataacaaattgttgttccagaaatcccaggtgaaaaaattatactttgaaatatgttaagataataatcagctttttcaccatattcaccaatacaaaaagaagccatttgaatgaaaggctgattgtttttattatttgggagttcttcttctattctatttaaagcaaaactacatatttcattactatttgaaacaaaactacagaaagaatttaatatctctttgtttatatatgaaggattttctttgaccaatctaatcaaaatatctattttccattgaggagaaggtgcaaatctctcaatgcatgtgaataactttggaacaatatctgcgagaaaatctttatcaacacttttcatgtgctccattatatcaggaacaagtttctttacattttgttcattaacaattgctgtaataaccacaagagctcttcttttaattgatacatcatcttgttctaagcattgaactatttgatccctatatctttgagttgaaagattatcagcacttcctctattaatcatgtttttatctgaataaagaattcttgttaatgcagaaagaattgaataacatgttcctggattattaggatttaataatcttccgatttgattaattgcaagagttttcaatgattgattcttgcatgttttaacaattgtttcaactgcttctaaaagaattgatttccctatatttgttgatggatctaaagtagtaattatactttgtaataaagaatctatttcatcagatggttttccaatcattccaagagtttttatagcaaatatttgtgcaaatggatcattttctccaacaaatccatgtgctctagttggatatatatttcttaaagttctaataagttcaatgcatgtacttatcattgattgaaaccttgttttattttcaatatttttaagtatttcacttacaatttttaaaccaacaattttcacggcatgagattgattcccaagaagagaaggaatacatttttttaccgattctatataatcaggattttctcttatacatgaaattaatgcagcacctgcacattttaaaactctaaaacttcttgatttcataataatattttcaatagatgaaaatgcatttgctattaaatcacttcctttgtaatttgctatcagtgataaagccaaacattgaactctttcttcataaaattttaagtcatttaaaactgtttgatttattagaagatatgtttcacttttgggatcaaataaaatacctgcagcaatgtacccaataaattttgtcgaaaatctagtgcttgccataacatttgcgatttctacaagagagaaagaaacgtcataacctgcatgatttaaaaaaattaattttgcaattatccttaagtgtcgtgatttttctttcatttttaatcgatttctgattcgagacagttcttgtcccatcatttcctttctctcctcaagctttggttgtcgtgaaatttcgataataaaatcgcgaaatgaatttctcattttttgttatggttttgttaaattttatgaaggattatttttcaaaaaaatcaaaaaatgaagtcactaaatctttagtgtttaagtaaatttaaatattaaagaatatataatttttttaaacaaaatcaatttttaacattattgaaatgataagttatttgatattaaacttcaaaagaaataatcaaatatgatattatgtcattactatactgataaatcatgtgaagaatgctttaataagaaaatatcattacaaaattttgatgagacataattctccaatagatatagtgaatttgaatagtttacttaacatctgacgataaattaaccataattctacatgtaaaacattcaaaaactccggcggttgaatttggtcattttaattcaacggttatttgacattcaaacaaatgctttttttactcttttctttagggtgcgctcattaccctcatcgaacatatggtaagaggaagccctcatctacttacaagcctaccgtctctaagaaaccaacttccacaacaaaaccttactggacaagaaattataatgataataagaagactccatgttatggtaaagcatcaagcattcttcctagcattgtaatggttgctttctaccttggttttatcgctattctcacaggaattatttattgcatattttcagcttgctctagttctcgtaacaacgaaaatgaaaatatcccaatggtttacaacaatgaaagacctgagagaacacgcaggaggcatggtcgctcacaaagaagatctcaaagaactccacaaccacaatatcaacaagttccacaacagcaaccacagtctcaaccacagtaccaacaagttccacgcgcacaaccacaatatcaacaagttccacaactacaaccacaataccaacaagttccacaaccacaaccagtatattatgttgttcaaaccccatctcttccacaatatatcccacctgttcaacaaccagttcaacaacaagctccacgtcaatatgttcaagttgttcctacaccaccacaatatgttcaagttgtcccacaacccaattcagttcctcaatatcaacaagcaccagttagagctgtatacccaaggccttaagctgaattaattaaacggtaattaacctcaccaattttaaacctcttttatgtggtcgagcggttttataaaacatgtgaacgatttcccaaattgaatgcttatcgttgtcatctgccaacagttagctaaattgtgttgaaattgatcgttttgagttagcattcaaaaaaccgccaggatgtggggtgccctgattttgtcgttgcagaaataacctccttccaatgtgtataggggccttcggccttttctgctgaacccttcgaaaataaacataaggtactcacaattttggaataaattccgatgactccttcacccaaaaaaattcattttataacgacggtttgtacattcaaaatattttaaaaccattcaatttggaaaaatcgccaaaaagccgatgacatcagttcacgtcaatcgattttttgtaaacttatcaattatcaactaaaatgatctcaaatcaaataaatttatgaacgttctatctatttttgctcttctctttgcaataacagttgaatatttttcagatggaacacttgaaattaatgaaacaagtgaatttacaacagaatttaaagaagtaacgtcgcgtgttataattggtggtaacataacaataattccaaatcgatctttttacaattgggacaagctgttatttgttgatattttaagcccagttcaagaaattggaacttctgcgtttcattattgttttgaaataatatcaattaacataggaaatagtgtaacaattataggaaattcatcattttatgaatgttcttctttgaaaaatctgacaattccaaattcagtcacaacaattggagatcatgcatttttcttttgtaatgaattagaatcagtcatcatcggaaacaacaccaaaaccattggagccaaagcgtttgctggtgggaacagccttcaaaattgtacaattccagattcggtcatctcaattggagattctgcatttgctgattgtttctttttagagctaacaaacgttggggattcggtcacaaccattggaaattcagcttttaataattgtcgatctctcaaaaatataataattcccgactcagtcattacaattggcgattcttcatttagttactgttattacttagagacgattagcattggaaagaatgttcaaacaattggaagttatttcttatataaatgttctcttttattaaccatcgaaattcctaattctgttgtcacaattggcgaaaaggcattttttgcatgtcattatatcaaaacatttcatataggaagtaatgttaaagagatcggacaaaatgcatttgaaacatgtacaagactacaaacaattacaatatcgaaagacaacaaatattacagtaattataatgatgacggaattatatacgataagaatttaacaaaaattatttatttctcagaaggtaatacattacaaacatttaatataccaacttccgttgagataattgaagtatttgcgtttcataattgcgaagttttggaatcattaacaattggagaaaatgttaaagaaatttcatctaattcgattttcaattgtaaaaaacttaaaaacataaaagtcgataaagaaaacaaatatttcactaattataatgatgatggaattctttacaataacgaaatgacaaagttaataagttatccaatcgagaaagaagatacatataatttaccaaattccattactgtaattggagataattcgttttataaatgtaggaacataaattatattaatataaataataataacttaaaagttattggaaattatgcattttatgaatgttacttcttaaaagaaattacatttccaaattcattgacaacaattggcgaatattcatttgttgattgtttgatgttaaatgtaagtaattttagtgttaacttaagagaaattgggaaacattcgttttatcaatgtattaatttaatgagttttatatttactgattatgttaatgcaattaatgaatatacattttataaatgttttaatttgaaatcaattaaaatcggtaaaaacttaaaaactattggaaatttctcattttatcaatgtattcggcttaaatgtttttatttttatggcgaaaatgagccaattattaaagaaaacgctttcgttgatgtgaaattgagttttgtaatggtaaattccgattataaatgtgataaattcggaacttttaatgtttcgttgaatgttttggttgagtgtaatgatattgaaccagaaccgaaaaaagataatactttggcaattgttttgggtgtttgtataccaattgttgtgattttgattgtcgttttcattgtgttttatgttaaaaaatattcaaaggataataagaattatgtaaatgataatcctttgatagagaaataagtaaaaaataaaatattattcgttttgatggtattaaaaatttatcgtttattaattctttaatatttgaggtgaataattatatattttaaaaagaatagatttaaaacaaatttgtttatttatgtttcatatggttatgataaaaatttatttctttttaaggagttgtacaatttctggataattttttttatatgcatacttaagtgctgttttaaataatttaaataatttccaaatattattttgaaatataaaattttgaaaatagattttaaatgaaaattaaaaatgtctttagctttaacatcaattccttcttgtttaagaagtaatttaacgatttctatatgacaatatttaaatgcttccagaagtgctgtttcaagaaatttaaagaatttccaaatattattatgaagtcctaatatattaatgaaaatattatttttcgcattaacatcaattccttcatgttcaagaagtaatttaacgatttctatatgaccattttcagatgctttcataagtggtgtttcaagaaatttaagtaaatattaaataatatatagcatgtaagtatatatattagtattaatatctactcccttattctcaataagtaattcaactaattccaaactacttctctgaaatgaaaaaataaaagctgcattaaatatatattataaattaaaaatattatattggaatattaaaaaaaaaaattaaaaactagtttggtaattttatcttcaatatatgaattgtcaattaaataatcaaaaagttctttattttcagaaacagtagaaattttcaaaaaatgtattgaaatcggatttttttcatgaaaatattgtaaaatatagaaattacctacttctaatgactcaataattaataattcattaactttcattcctactttttcagaaatgaaagaatttcataattattatgcaaaacgcactcacttcctaatttttctaaattactaatttcttcaattttattatcataaatatatttaaaaatatcatttcgatgaaattcaattgcagctttatatgcatctttaaatgatgaatgattttgttcacataaatgaacattttcaatgtttccacctgcaattgcatatttgcctgtgttttctacatttgcaccattcataagtaaatatttaaaacatttgatagcagaaaaaaatgctgcataatcaattaatgaaacattgtttttattaataaatgaacatctttcataaactgatggttcaattgtttgattaaaatcaaaatcgctttgtgatgatatttcttgaagtttttctatttcatcatttcgaattatttttgcaatttcatttggattatgtccttcttcaatatatttcttatgaagttcccaatcattctttgaaagttcttcgtaattattaaaaaattcatcaataaatttgattgaatgaaaattgtacaaataataaaattaaatgaatatgaaaattcttaatcaaaataattcagagttaattcaacagatttatcgatattttcattgtttaagtcgaatataatttttttaagatattggagtatttgtaaatttttatcgaatttatgaacatttattttgccactttcctatcgaactattactatagtaccacatcaattcatcgctcatcgagtcaaaattgacgaagtctgttcgcgtcaaaaattcaaatcacatttcatgacaaatttaagatttaatttcaacaaaattttattgttttttctcatccattgttgcattattatttgtaattttctgggttctttttttcttcttgaacaacaaagaagacaaagacttcactattgcccatttcaaattcttcttcactattcttgtcaatctttcctttgttccgaacaagtcatagtaatggaatcccggatacgagaatcctctgtccaagaactctgacagcaatccctggtcctttcttcttacgcaaatgccagccctgaaagggtgaaactggaaattctggcagaagaatatgttttggttattctgcgtctgtatatccgctgcagtttcgttcaatgcgttaatcatttcgtcttccaaatcgttttgttcatccatttcatcttcttcgtccaatatgtccaacattcttaattcgtctgacgaagggaaatattttattaatcgtttaaagaacggcatattaattcttatgacaaaaggcgttacgtttatatctattttttggaagacgggacatttcattatggaataagctttgtttaagtttactgttaagaacttctctttttgcgtctcaaagatcattgagaagacatcagatgattgttcatctcgagcaattatttgattaatgatgattgacattgtttcacttttatcttgtttttggattaagtcgattattattttatttgcgtttaatgatgcaattactgttttatcttccattaataatcgcaaattaattttttctaatttgatgtttaatgtttttattaagtttttcattttgtttggtattttgagttttttgttctcttggaatttgaagtaataatgttttattgtcggaatgaatatacaaaagtcttcttccgtcggatttattgatataattttgttgttaattatttggatttgataattacttgctttagcaaattgatattcaaataactctaatgaaaataatggaacactattcgatgtaatgaagttaatcgatgatatcattactgaatgtaatttgttgttgttgtcatcaagtttttgttggtaactaactgtacgtgaatttgattgaatgattcgattttcatcatcgaaacaaatccgtaatatcattgtctcgatcgcaaaagcaaatgaattcttatagaattgtatttgtaaatcaatttcattgttgatttgacttgataaatatgtttcttttgttacttttggtgtatttgtttcaggtaatttaatgttaatgttattaatacatttaaatattcgtgaatgaatttcggaaattaaatctgaaactataactatgatataaccttcatttaaatcgaatttaagatttataagttttaattttaataatgcttgttcattaaatgttgttaatattttgaatttcgatgatttcgctgataattttaattgatttttagatgttaatcgaaagttaataggttcccctttagttctgactaaaaatgacccttggttaagtaagatattaaaatgtggaaatgtaatatttgcttctattccatataatttaggattcaaattcttattaacaaagaattgaacggggtttacataaccgttcattatcggcttctttgaaaatgtgttaagtaaatcattcaaataatcgagattgaaaattgcataattatttgcttcgggaaatgtaacattaaattgtattgagtatgtatgcgttctatattcataatatggatcatacgtcggatctggcattctatatgagttatattttataaaaacaggccgaggtttagtttggtttggattaaatgatttaatgttcatataaatgtttggatatggtaaacttccaatgaatttgtagtcaagattatgtaaaatcttaatgtttatcatgtcacttgtgatgttaaaatctttcccattatatatagtatttaaattaattaattggaattttaatggtggaaaattagtatatacattctcatttgttaaatatccaacttcgaaattattagcatgtaaatcaaatttgaacctataattaattcgataattatcaaatagacgtaatctttggaatacatatttcttaagttgaaatctcttcattccaattttacggttttgatcggcctccttaaaagcgggcgactttttgaatacgatctcttttgaatttgaatgaagctcgataaaagaaaccgactttgtcgctaaagagggaacgttaaataccgttttgccgttatcacaagtgattctgacatgtttaaagtcttcgcgtaatttaccaataggacctccttttaagaaatagccagtgttattaaagtctacgaaagttaataacttagtaactttacccattgatatttcgaataaagaagaatttaatgtgatttttccacctgaaattttaccaatttcttcttcattaacttcgggtaaaatttctttgattttgtttaatccttcattaaagttctttatcgcaggtccatccattataaacttaaagttcttagtattaatcgctattaaatcttctttttcattatttttcggcatttgattaaaacattctttatataaattaaataataattcgttgcttttctgctcgaaaatgttttgattaaatttaattcttttcttcgcagatattatttgtattgctctattttgtctcatcattaatccttccattgcagatcttttcgcttcgaatgcttttgatattgattgacataattcattctcttttaatgatactttaaatgcttctgattcaagtgaaaatattttcgatgtcggaggaagttctttacgatttgctaatggtggacctcttctttgtttactcataaatgaattcattccaaagaattcgaagatcatcgattgttgtgggaatgaattagttaaaaacatttcgcaatttgtacaaatgattccgaaatttggctttgcaaaattaattctaactcgtgagccttcaaagaatcgatgtataactggtggcgatatttgattcactattaaatgtttcgacgaaatgattttgttctttaattggaatgatttaaataagaattcatattgatgcatatcatgtaaacaatatttaatcttcgagatttgtttcgatgtaactataaatgaattatcactttgttttgttgttgttgttgttgatgttttctttggtgaactctttgagtgatttaaaaatcgcgttaataatgatttgtcaattagtaatgtcgaacaaactgttaattcgaaatcttctaatatcaaatgtttgttttctaattctaatgatttaactgaaaataaatgcgacgaatttcgtgtggaattgattacgccggtggaaatccttccattggtatattgtatgtcatttatttcgaagtttatttgcttagtgtgtaagtctaatttggttaaatgtatttttaatggagaaatttgaacattagaaacagcttcttgttcttgtgggacaacacatgacatcgtaaattgttcagtagttataaggccgtcatcataattaagattaactttagaaattgtatcaacaaaaactgaaagttgactgccaagaagatacttaagagaattcatggaactggtggtcttaacttggatttccggaatacgaatagataatgggcctttggaaagataaagttcagtgatttgtaaatcagctttgagtgttttgatttcgggaataattatccagtcaaaaataatggaatgaatagatgttgtggaatttttaacctgaaattcgatgtctttgatggtgattttagctgatttaataaaaagtacaaaaaatatgtaaaataaatgttcaagaatccacctaccaaaaggtgtggccttgtgttgcttctctttgttttcttcatttttggaaatttgagcaaaatgaaatttagtaatttcaatatcaacaatgtgtactttattagacgtatttgttttaaagaaatgaaaagaaatatcaatgtcttctaccacaagtttttttgatggagaagaaccactgatttcacaaaatgagaaaaagttaatgcttggaattactttgctttcattactaaatattttgttcattgtttttttgattatttcgattaggatccagcgtaataatatacatgtaataaatatgattaaagaacaaaaaaatgaaaacccaagcaaaaacatcccaaaatgtgacagacatgtgaccatataagcattgaaaatcaaggaaaaaaatttcttctaaaagaaatcaaaagaataaattttaataaatacatagaaagaaaatggtcataaaagatattgtttttattggtttgtgcttcatttgaagacgaaatataagaagacaactaataaaattacaagaataattacgatgactatccataaaatggcagttctcctcttttggcggcacaacatcttttcggctttctcataaccttggtcagctccactctcaacttcatataatccattcataatcttattttctttttcggcttgaatacctaactcatcgataataccaaaaccagtgcccttaattccgttgactgtttcgtgcatttcttgaaggagtgctgagccttgattaagtttatctctttgcgatacaagttggtcacgttgactttgagaagagccatccagatttcgaggtgatcctaataattcatttcgatttttagccatgttgtatctattttccattgtattctttttttgtctaatttcttttaagaacttgactgcacgcaggttatcatctgcatccattaaaatagattctctatcgagctcttccatgttggaatttaattcatttaataaattttcaatttttctctgattatcagaatttcctccttgtgaagaatagttggaaatttcaccgtcaagttggaccataagatcattgatgcttctttcaaatagcgagaactgtgtcattttgggcaatgattttttctgaaattttttgaccgaggatggcggtttatttgggcactttacaaaaaagccttctcctaaagaaaaaccaaattaccgctttgcaaatacaatttgcatcatttatacatatttatctgaaaagttttggattatttataattttaatttccattgtaataaattttttaataatgcaaataatgctttttataattcaaaaattcgtaaaataaaaatacttttaatacaaagatcgattctttttagcgcatgaagcaattttgtcataacaacgcacgatcgtgcgttcaaaaatttttaatatgttttgtaatggaaaatgaatctacagaatattgaatgttttgcagatattatttaattaatgatgagatttttttcacattttcctatgtggatttgatgatattttttctaaaataatgaaagtattatcaacagcataattcttatgagcaattaatgaataatagcaaatttgtataataatgagtttccattattttaatttcaataaattcattgataaattttaaatttgtctaaaagataaaacaaaagctccttaaatctcacattataatgagtgaatgaaaataattcataattggaaagaaaatatataaataatcaatacgcattattattttaaagtgtaaattagatatatctcttgcatgttaacattctagagtatatccactactaattacgcccattaaacatgatttttttggaaaatttacaccaaaaagtaatataaccaaataagcaaagaaaaattccaacggctatgtaaatggaaccgttaaaataactacaacacaagttgaactatgaaaaagtcataatattgagataataatatacaaaaaaccgcaagaccacttattgtagctacttacgataaaatttgagaggatgatccaacgcaaaaatcatttcactctttaatatgaaggttcttattgttattgctcactgcgatccaaacaagaatgcaacagcatacaggtttgctaatgcctgcaaagaagccttagaagcagcaaagaatgaagttaaaatcactgatcttgttcatgaaggtttcgatcggactgctacacctgatgactttaagaagattgctgatccaaacaaattcaactacatcggaaaccagttaccagctgacaacttatgtgaaaccatcaggaaacaacaagaactcattggatggtgtgaccacgtcgtcgtcattgcaccaatgtacttcttccgtttaccagcttgtctttatgcatggttcgaacgttgcttcacaattgggttcgcatttggcaaggaaacaatggagaaaggcccactcaaaggcaagaaggcatcaattataattacagctggtggtacattagctcattttgcctcaagaggatatgctccacttgagtcaatattatattcatcaacttatcaattccgttattgcggtttcacagcaacacgtacattactttatccttctgctaacagtcctgaagttgtcgaaaaggaaggtgaatatattgagaaattaaagaaggcaatcgtcaaacttgattcatggccacttcttccaatcctccacggaaagccacaagaaggtgaaaagaatgaaccagaaatttttgcacaacttgagccattacttgttgatgaccttctttgaggttgagcttcagatttttccatctgaataaacaaaatggtgaaacatgagatctttttaactcattgttgtagcatcatcagcgtttgcgcatttaaagtaacgaacaaatttttatttgaatgaagtaactttttctgatatatcatcagttgtcaatttaaagacttttcagaggattttattcaaaaaaatcacttttctaagaaaggttcgaatttgccatatcacatgacttgcgcaccaaagagagttggtcctggaggtcctaaagcattcgatatggatgcatcacgtccacctgcatgtcttttctggaatcttggtgaaaagaactgcgatggagtcaatgttcaaatcaaaccaacattatttagaaaatgggaacaattattaacacacttagcacaaaagtgtggatgtggtcaaggtgtacgtgcactcttcactccatctgggcatcaacttaaagaattttctgaattaaaagatggaattgatgttgttgttgttccatccggatataaattcgataagcatcgtctccctgttaaacttgccgccaaaatcggtgttccaacaactgcctaaacatgcattgtctaatttgctttttttcgacttagtgtcaaactccaattcctttaacaaataagtatttgtttccctgcaattattgcctcccacaagttcaccaaatcaaaagctcaaaatagggaactaaggggacggttttctctcaaaaagaaataagcaaatcacgcaattatttgtaaacatcagaaatagaattttttgaatcgattttaatcagattttcggcatcgatgcctcctatcgtttgttttcgataaaagtgattttggcggctcccaaaaaatatgtgcgtcacaatttgaaatatttatgagtaatatgatatgctgcaaggttagcctctacaatattatacattcaaagctgctaaagattttgaaaaaaaaaaaaacaattttataaaatttaatgtttctattggatttgctataataagcataaaatatataataaagaaaacataagatatgccaaataacaaaaatgtttgtatttaataaataaaaaaaatttttttgttattaaaatatgtttatttatatctgactgataaatttttcttctttgaaatcgactgcaaatggatcttcttcaatatttgaattattattcccaactgaaaatgtattatctatttcattaattttattattattttcatctgaaaaattcatttcttcttcattttgttttcgcttcatattttgatatttaatcataaatattatgattatcaatacaaatacaataattattacaattacaacaacaattataatgataattaatgtattattatcatcagtgtttattattacatcttcgatataagaaatataaaagaaattcgaataataagtaaaatattctggataatatataattgtataattataatatataaaatcgacataaatatatttagtttcagattcaatgaaagtaactgaataagattttaagaacgtataataataaattgataaagtttttataaacgataaaaaataagttaaagtataagtgttaacgaaagtaaaattcatcgaaaatgtatcaacataagtatttgactcaaaagtattttttgatttcgtaaatgtatttgatttgataaatgtattactaattgtaaatgtatttgagtcagtaaatgttcgtgttggcgggagacatgcgtcaagtgttgttcccttagtaatttccatatttccaaatgtttcattttgatatgtttctattgtcataactgttgccgcatttatattaacaaatgcatcattttgtatttttggtgaaatttctccattaaaataaatacattgaagtgatgtacaattaacaaatgcacatgaattaatatattgaacattttcatcaataaaaattctttctaaattattacaataagcaaatgtataattcataatagaaatgactgatttaggaattgaaaatgttttactgttcccattcggataactaatgatttgtgtaatttctttattatataaaacgccatcattttcataactcgaatatccaatattttcatctgaaacattaataaattgaagatttgtacattctaaaaatgcatttccaattgaagtaacagaacttggtatataaatattcacaaggattgtacaccctctgaatgcatcagcgccaatatttcgtacgccttcatataaagttatcgtttcaagtcctgtacatttataaaatgcattatcactaatggaattacaacgaattgtaatattatttaatgaaatacattctgcaaatgcaccacctccaattccactcattaatttatctggaaattggacatattctaattttgtacatgatgcaaatgctccactatttatattttcaactgtttctccaattattactgttgttaataaaggccattctctgaatgcattactttcaagctcgccaacatcaataattataatgtgttctgtaacattcatataatcatttgaataatcattggaatcagatattgtgagtgtttttgtctcttcgtcacatgattgctttgtattaacaaaaaatataatcattaaaatcaaaaatattttgaaattttgtttatttttatcataaattaaataacttttataaaaatatttaataaattgaaaaagaatattaaatataattaaaaatgatataatatataaattgttaattgttgatttaaatatgtaatataagaaattcctcaatataaaataaaatatttttactttattcattatataaatatcaaaataaatcgaaattttcttcaaagtataaataaagtgatatttaaatttataaaaagtaattaattcgaaacattttttcataatatcaaatggtgttataaataaatgacttaataaatgataatatttgcaacttattttatggtactttatatatgagaaaaatgaaattttgtaatttgaatgatttttgttatgatttgacaaataatgaatatatttgttctgttgaagttgatttgttgttacatttttgtttttgaaatttatatattttatatttttatgataaattttttcatcgaaaaatatgttggatataagatcaatgaaatgaatggtgaagatcactaatatacatatttcgttatttttcatcaatttgacgatcgtaattacaagatatattcttgattttgactcaaactaataaccttcaaattttcatcaaaaatgtatgaaattggttgttttccatctgaaattgcaagtgtcatcaaaaatttaatcaatatgagtcataaacaatgataagtgagatgataatgttttcttctcattttcgcttttagcttgatacaaaatattcttgtaatcatatcaattttacacacaaaacgatcaaaatcactcaatacaacaataattcaatactgagctttcatatgaaattatcaacttttctatatagtcatttcaattattttaaaatccaactgccttttacagtcaaattaaaatctgatacattaaaaaacattttcacataaattatcttcataagcaatgaacatttttaaaaaaattttttattgttttttgatgatgatagctcctttcttgtattcagcagtgatttaaaagcgactcatatgtccaaacaaagcgatttattcaaaaagaaagaacaaatttattttctagataaatgaacaacaaaaaaaaaaaaaacgattttttcatttaaatttataaactattcgaatattttaacaaacgctaattaatcttggaattcttaagctattccaagtatgtaataagaatagtccatgttttatcattgtcctattctcttatattttcgacagaaacaaagcaacaacaattaatttacttctttgaaactcatattttaaaattttaatatcattttgtagaagttgtatttgaatgcttgtcttcaaatatttggatagaaattatttttgtacaaaatggcattgaaataaatttagtatcttagaatttcataaagttgaaagtgatttacacttatgaaaatatcagaacactaatagagttgtaagataaaatggacattcatttcataatttataaaaaacaaaacatttattatacatatatacatatatccatgcgagcacacacatttagtccgcttgctcttcatctatatcaaatgacaatatgtttccatcgctcaaattaatctgtcttgacactattatgaagtcattgatcacttgtcttaacttttcgcagctttgcgccccgtttattatttctccggagatacaccttagttcatcctgggtaaggtttgggaatgttgaaaccaacttctggaagacgaaatcaaatattttggtcacgtccaaaaaatttaattttccggcagctgcaatttggagcaaatgatacaatgactgcgtgacttgcgagaacaagaaagaatgtaatccgtcaaacatcacatcaaagaattgtgatattagttcgaaataaaacgttgaataaaagtcattaatcacatttaaatcgttgtttgaatctaattgcaataaaactgttgaaacacaattgaacgataattcagatatgtccgtttgtggatgaagcatcccataaaaacaataatgaaataagcaattaaacatttcgcgaggtatctgaaagaagtattcaaaaatggatcgaattaatttataaaaaggtaaacgtatttcggggtactccgtaaacgtcttcgaaatgtgttcaaaagttggcgccaaaaagttattgaataaatatgggactaaatcgacattgccttccttgattaatattgaaaaaaattcaaatgcttcaaaagaatgaaatttaccaaaatcagaataaacttcattaactaatgtggggatacaagatgattgtggaaatgattttagaaattcttggaataattcatataattgatgtctttctaactcattttgtgtgttcttaaaatcatttattatgttttgaataatttgttcaatcgattgttgaaaatcatttccaacaattgatattaattctgttatgatgtcaattcgatttgcatgatttaataaaacgactatcattttttgtctttcggcttcatctcgacaatttttaacaatatattttaaacttataaaaaatgattgatgtaaaaaaggagggattttttgtaaaagaacatcaatttgctcaaatatttgattcgaataaccgttatcaacgatcaatttcccgcaactttttgttaagtttataaacgttttgacggctacaaattgggcaaattgatttccgcttacaaaatactcaaaatgctttgataatgttatttctaaaataggcaagttatttgctaaataccgaggatataatgatactatatacataaatgcggcagttatttgaggtgaaaattcatcattattttgcataaatcgtaataatgactcaatgataatagacaaaaacgccttttcttcgttttctccacacacacctgagattgcgccaattgaatatataattggtaacatttgttcatcataatttggtccattaattttttcgacaatagcacctagaatttcatctttatgtacccgaaatagaattaaaagagtttcgctcatcttatcaaagagttctttgtcaccatcgtactcgggcggttttgacatgcgaccacataatgactgctgcagtgggaacaagaaacaatttgagaaaggaagcatttgtgtgtcacaaataaataccttggcaaggtaatgccacatgtcaacaatttgggcaaaaagttcttcatcaacaatttttgtatattctatcatccattgaattacagtgtcatttggcatcaacgcacatcgatctaacgttacaaactttataagaatgtttacaagtgatggaactaattctttgtcaattaacatggttgaatcattagaaagtagacatataaattggttaaatagcgtgacaattaatgggtttgctgtagctctttcacgtgaaacaatagatgataaacatttaagaattggaattcgaaaatgtggatatggcataagatcactaaagaaaaaatcaaatatcttgtcgtcttctacaaatttaagatcaacccattcgagatattgggataacgtaattaatgattcaattttgatttcttccatattgttttcttgcaaaaaagcaaatctaagaaagttatagattatttgaaaattttgatataaggccaaaatcaattgcctcttttttgaagcaattaatttggaatgtcgtatttgttctgagaaacttccaaaaaagtaaacacagttgagcatagtcatgggattttcattagaaatagctatgatatcagaaataaaagaaggccagttttcaggccattcttcaaataggatttgaatcaatacactatctagttggcgaagaacttgaatatttaacccttttgttggccattctcgaaccaaatcaaagtaaaaactttttaattgtgatttttgttgttccgaaaaaagattccattgtgattttattttagacgcaatagctgaaaggcagaggtattttgcttcctgagaagttgaatccgtaaataaagtgtgaaaaatgtataatgaatatggctggtcagataaggattgaattaattcgcgtgatttttcagattctaatgtattttgatagaaacatttagctatttcttcgaaatcgctgacttggattggaatggttgaattcattttttggattaccaattttgagtaaagtatccataattgaacgtaaaaactttgaattaatattcaataattcgatgtttcaatgtgtcaaaaaagtgattatttaaacgtacgccaaacctaaatgtcactttccccatcggttacatcattaaaagaaacaaaaaaatcaataaaaaaacacatgtttttgtgaaaccctgaaaatgtcatattaaggttttcatttacgacatgaatgacattgagttttagaaatattttgagtcataacattctaataagatcaaagaatacatcattttacattaaaatttaatcaaatgagaattgaaattattagattgatgtagatataacgaggaacaaaataataaaatataaatctcatgtgtatcaaagcaccaacgtcatgagtgaggagattttatacgatcaaaatagattcaaaatatttctaaatttgaaactgaaattatcgtatttttttttaagtaatcctccttgtttaacacataaatacgatgcctttgtcaaagtaaatttcaatttgctcactactttacttgtgaaagcttctacaagtatttaaatactgtttagtaattcaacaaaagcacttttgttttcaaaaagtcaaaatcggtttaaagtgacaataaattacgcaatagtacttgtttatttctataactaattatccgagttgacgaaattaatcaagtttttaaggcctttgattgaattatcatcataagaagtatcttttgagtttcctccttcagcttcaacatctaaataagcatgtgcaaaatcaataagcttcacattcatcggagcttcgtcatcatcaccatcatacacagcaaggacagatgctgagtaaagtctcatattaggaagaattgcctgagtttctttcagctttttggaaatgttctttatcgcgcgaacgaattgcgttcttctttttccattaagaaaagttttcaaaacatgtgcaaatttcttggcagtcatttgtcttccttcttttctatcccaatggtgtacaacttctccattacgtcggatgcatatatctatgcacctaattgcataagaagctgttgttgtattaaatatatgtgagaattggcgatttgccttttcttgagaaacatcgacttcaaatgatcgagttccaagcttaatatctgctatacaaggcgaactcatgtttgcggttaaatcttggagaattaaccatttcttatcctcataaacagttgagcccaagaagataggcaaacattggcagaggggggtgttcttaatgttcttgtaaaaatactcttcgcgaggtatgagtggctttgccatggaggcgattgggccataaacttttttaaatttaccatgcccacctccttggttattcaacacaccttgaaactggtaatcttgttttatacttttacttttgttcaaagggctcgaagttgttgaaacacaatccataaaatggaatttgagttcaactttttttcaatatgcttgaccatctaacttatctcaaaatttgagagtcataaaatgttttaaaaatgaaacgatatgtaaatggaacagttttatttcattatcatattgttcaactcaaattaatttgcttaaacatcttattaatttttattgtactatataaatacaaagtatcatcaaatataatatatgttattctttgaaaattggctttttttcaaatttgccaaaaattcgaaaattatcttaaattgaaattttgaatgtcccagaaaatttgagtgcaaaaagcaacaaagccgtacgttaactatggacttcttgcattggaccaaaactaccaatttattgatcacgaactaacaaacctcattgtccccaacaagctcttcttcttgcacaaaagcaattcaaacatatgtttatttgacacaattcaatccaacattgttttctatttttttaaagtaaatttcagaagaaaccccatcttcacaaagaaagagcgttaattggtgtcttcgagagttgtcattattaaaaaagagtattcgagatatctttcaaatcaaaaacttttttctccattttatatcaagcatattagcactacaaaataaaaaaaatcatcaattatatttttacaaacaatttcatttttttaaattttttaacattcacttttacccaacatttcttcaatttcatgtgtttgctttctgtactcttcgacatgttctttcttcgtttgtatttcttgctccagtgatgaaatttgtacgtattcagcattaagctgctgtaacaaatatttaacatcgtttagttttttgtttgagtcttcttttttcaactcttctctcttcgataaaaattttagttcattttgtttccttttgatttgattttcagaaattaacatcttttctttgcaagcgctaatatctttttgaagggattcgatttttgcatctgttttttgctttttttcattaatatcttgtaatcgattttgaatgcttataagttgactaatgatttctttgcccgagtaactttgtttatttgatttgtaaatcgccgaaagaagttgaggcttcattgataataattgagggtattgttgagaatatgatgtgaaatttgttgtaatttcagaaagaatttgagggaatttagacatggacattgataaaaatgaaatttgaagagaaacatcattagtttgaagaatttgaatttctagctttgaaaggatttcaggacattgccattcttcgatgatctgaattagcgctggatcagcagatttattggtaaggtggagaggctgtgattgacataaatctaaaaacatggaaaaaatttcttcagaataattatcaaaaattggcgaatccattccaaatcgttctcttgctcttgtagatattgaactcattttttctaggtttatggtgtatttatgattattatgatttatttgttttattttcattttttggagcaattaacgtattcttggcaacaaagatggaggaaaacgtatctgaagccaggaaaataagcttaaaatattacgatgattttttatctgaaattcatgcatgcatgaaacaggctgatttaattttacaaaattcaagattaaatgcagaatcaaaagcctcaacagaacaaaataaacaaacaacaccaaaaccacgcaaaaggtcacacatcccttctccatcaccacaatcaaaatcaataagtatgaattcaaaagtttcaaattcaaattctcgtggaaaagtttcaacttttgacacaattacaccaaagagtaatattcccaaaacgcctacttccaaatctcgacaacgtacatctctaatttcacgtaaatccaaagatccaccaaaggaaactctaaaaaaagttgattccgaaaccaagcgagcgcgttgccaatccccaccaagttctccaaggaagtcaaccaataactcaacatataaaacattaattcctgttctttcatcagaacggagatcaagttcagctcgttctggtgccagatcagtacgtagtagcttcaggagcaagaacattgaggataaaaattcaacaacaaataatttaagaaaaagtataaatcaaaatgaagaaaatgaatcaaaaattatcacgacaaaagaacgtcagaaattgataaagaaagaagagacatcaaataatagaattgttaggaagaaattcgaagaattttcaccgaaacaagtgaacgcaaatcgaacaatgaagaaagaaacagaagaaacaatgaacaaacaagaacaaagaattaacaaaacaacaaaagcaaaggcagaagaaatgccaagtaaacaagataaagcgcaaataataaaaaaggaaacacaagaaaaattaaataaagatgaacaaaagacaaataaacaaaaaacagaacgaaaagatgaatggacaacaatcaaagatatctctaataataactcaaaaatcaaaaaagaaaataagcaaaatgatgataaagatgaatgggtatcgattaaagatatctctaataataacgcaaaaaccaaaaaagaaaacaagcagaatgaagataaagatgaatgggtatcaacgaaagatatcgctaaaattggtacaaaaaataataaagaaaaaataaaagaaagcaaacaaaatgaagacaaagatgaatgggtatcaatcaaagatatctccaacactaatggaaaagccaaaaaagaaaataaacaaaataatgataaagatgaacaaaagacaaacaaaataccaaaaacagaacgaaaagatgaatgggtatcgattaaagatgactctaatacaaatggaaaagccaaattagaaagtaaacagaatgaagataaggatgaatgggtatcaatcaatgatatctttaacactaatggaaaagtcaaaaaagaaaacaaacagaatgaagataaggatgaatgggtttcgattaaaaatatttctaatgataatggaaagaccgaaaaagaaaacaaacagaatgaagataaggatgaatgggtatcaatcaatgatatctctaacacaaatggaaaagccaaattagaaagtaaacagaatgaagataaggatgaatgggtttcgattaaaaatatttctaataataatgcaaaaatcaaattagaaaataaacagaatgaagataaggatgaatgggtttcgattaaaaatatttctaatgataatgcaaaaatcaaattagaaaataaacaaaatgaaggcaaagatgaatgggtttcgattaagaaggaatcagcaccagcgaaagtgtccgctgctcgtgtacatcacaactttgaggataaggaaatgccaaagatgccaaggtgcctcaggaacccgccaaaagaccgcaatgtggcaactaaaactgaaacaagctaaatcattaaacatgtttttaagtaaatttcaaaatatttacattctatgcataagctttaatcctatttccaaatatttggtacaattttaatgagattaatatctttgaattaatgtcactttcgaacttttttaagtaatttgttgtcaaatctttattaatgggaaatcgatctagtaaaccaaatgttccaaatgagcatgatacaacattaccaattaaccctttctcaagcaagtggatgcagaatttacaaatgcttgaagaaattattttaaacttgaatgaagaaaacttttttaaatcaattcatgaaataactaattaccttggagataattttttagattttgaagacctcagtctcagtagatttatttattctgcatttctttcacaaatgaaagatgtgaatttatgtttgaatttaatcaaagaacttaatataataattacatttacacattatcttctcaatttgtattctcatgaatctttttttcttcttgagatgatgatcaaatcaaatttaatatctgtggatttattaaaaaatactgaaacattatattttgcacattattcattagaagcaaaaattaaaatgttactaaaaaaagatcaatatttcttaaataacttaaaaagaatgattgggaacttcataagaaatatattgaagaaggacataatccaaatgaaattgcaaaaataattcgaaatgatgaaattgaaaaacttcaagaaatatcatcacaaaatgaatttaattttaatcaaagaattaaaccatcactttatgaaagatgttcatttattaataaaaacaatgttacactaattgattatgcagcatttttttctgctatcaaatgttttaaatatttgcttatgaatggtgcagatgtggaaaacacaggtaaatatgcaattgcaggtggaaacattgaaattgttcatttatgtgaacaaaatcattcatcatttaaagatgcatatgaaacagcgattgaattttatcgcaatgatatattttattatctttatgaaaacaaaattggagaatatgataaggtacatactagcatgtttttactttcaaataatgaagcatttaacatcaacttgcttaaatttatattcgaactagaaggaattgacataaatgagaaagatgtttactttaaatatttggtaattctttatattatttgaaataatactcattcatgcatctgaaaaaggtcaattagaaatagtgaaattgcttcttgaatatcttctaaagcaaaaagtaattgatatcaatgctgtaaacattaatttattttatttaaaatttgttttaataattttttattttaaaataatatttggaaattatttaaattatttagaacagcacttatgttgacatctaaaaatggtcatttagaaatagttaaattgcttcttgaacaggaaggaattgatatcaactttaaatatgtatatatactttatttaaaatttattttattaaaataatatttcaaaataatattgggattatatttaaattatgcgatacagcacttatgttagcatctgcaaatggtaaagaagaaatagttaaattacttcttgaacaagaaggaattgatgttaatcatattgatattttgtcatatttagaatgtattttattaatttaacattttaatataatatttggaaaatatttaacatatttaaaacagcgcttgtgtttgcatctgaaaaaggttatacagaaatagtcagtttgcttcttgaatataaaggaattgatgttaatcatatggatattttgttatatttggaatttattttattgattcaataattaaaaataatatttggaaactatttgaaatattttggacagcactttttaaagcatctgaaaatggtcacgtagaaatagttaaattacttcttgaacataaagaaattgatgttaataatatagacatttatatgttttatttgaaatttattttattaatttggaatttcaaaataatatttataaattatttaaattatttgaaaaagcacttatgattgcaactgaaaaaggatatatagatacagttaaattttttcttgaacaagaaggaattgacattaatgccgaagatatttgttatttttatttagaatttattttaataatttgatatttaaaaataatacatggtaatttttaaaattatataacaatgcacttgtgtcagcatctgaaaaaggttatacagaaatagttaaattacttcttgaacataaaagagttgatgctaattgtggggatattttgttaattggtttaatatttaaaaataatatttaaaaattatttaaattatttggaaaagctcttttgattgcaattgaaaatggtcatacagaaattgctaagttactatttgaaccagaaagaattaatactcgatttatatatatataataaatatttattcaattcattaaatgttgttttcttgaaattttatgtttccaatttatatctgaaaattcaataaaatatttaatacattactcattatagcatctatgaatggtaatattgaaatagttaaattacttattgaacaaaaaggaattgatgttaatgttaaaaatattttaatgttttattcatagtttatattatttattatatatttaataatattttttgggagttttttaaataatttcgaacagcacttatttttgcagcacaaaatggtcatatagaaattgttaaattgcttttgaaacaagaaggtattgatactaatattaaagataaaaattattcacttaatatgatatttcattataaaatatggaatatattattattatttgatacagcacttatgagagcaacatcaaaaaatcatatagaaatagtcaaattacttcttaaacaaaaaggaattgatattaatgcgagagataatatttcttggaataatttaatattttactattatatatggaaattattttaaatatttaaaacagcacttataagtgcaacagaaaaaggttatttagaaattgttaaattacttcttgaacaagaaagtattgatatcagtgctatagataatgtttcttgaaataatttagtgttataatatactatttggaaattatttgaattatttaagacagcacttatttgggcatctcaaaatggtcgcacagaaatcgttaaattacttcgtgaacaagaaggatttgatattaatgcgaaagatacatatttgttctatctaatacatgttttaataatttggtatttcataaagatatttggaaattattaatattgtataatacaacatctttgattaaacatgatactgaagttgttaagatgcttaattcaaaaacagaaaagtaaaactgtcagcaaaatataatgtggttactaggaaattatttacatcataaaaatgcggggagatatatttaaaaagttttaataaaaattatatgaaatgttttcttatgtttctttttaaattgtataatgcatgtaaatactaaattgctaatttgctttgttcatgattataatagatatgtaacaataaactttacttaaaatcatgtaaataatatctgtatcagaaatggataaaattttatattttaaggaaatagtcatttcttcaattttcaaataaagtatagtaaatatcaaaaatatctctaatgtttttccatataactccaaccaaagagaattcaataaaaagatgaggatattgaaattttgatacacttattacagtttcggataagataatgactgcattaaaaatttaaagattgtaattttaatatatagaaatttaaacttatccaaagttatttaaatatcataacaattttatacatttggtaacatcaatcatttcttgtaaaaacccaagaaatagagtcagcacaaaaaatgtaccgcagccaaataaactcagaaaaacttacaaaacacgcacataaactctcaaattttgtttgctctttaacggttttatatttatgggcttacaacagaaattgtacttttatttcaattttcttaacttatctgcctgaggcccagagtaaaattttagcattgaaaaattaaggaacgtctaatagaattttcaatgaaatgataaaagtttttcaatggaaacgatatttcttattgaattatggatgtggataaaaaaacaaaatcatcgagagcccatgactctttcatcagattggaaatgaataaaaagatacacaaatcaagcaccttggtttatttattttttatatgtatatggtttaatatttcttgaatgaataaataataataataataaaactagtttacattttctaataattttcgcaattgatctgacttgaaatcaatcttatctgctaattgtgggaatataattcgtggaggctttggctgttcaggttgttgttcatttgactcctgcactccttttaacgcaaagctgttttcagtattaataggctcagtaacgagtgtttctgggtgaataccgtttccgcaattaattgcatgatataaacttattacataacctgaatgcctatttatccatgtccatctattctttatagcattaactgaccttccagcaaagaactttgatattgtggaccacttatgtccatagatattagataatttaacaagcaataaatcttcttgaaaattccaatcatttttgttgatacctggagttatttgatttacccacctttctctacattgttttccatttcgatttgggagttcttctgcaatacgtttccaatttgttggtccatacttctgtacacttttccgaagtaagttgtcttcttcttcagtccatcttactttctgtggctcgcgatttcttttttctttaaacatggctgacattaaaaagaatttaaccgactgactcagttccgattccccaaaccttcaactgtttcaaaaagtcaagttatttaagagaacacaaccaaagcagttttttgaatgcgttgtaattcgaatcacacgttgattttcaatggtcttcacagaattttctgagggggtttggtatttgtgatgatagcgcacaacctatggtatcggaccccataattttctgaaatctaattcaattcaacacaattgttcacagttgttgtaaaatttacttaaattttccaattcaaaattcgataattaaaatgggaaggtgcaatcaaataaacgtattcccctgaacattaaaatttaaaattaaatttatcaaatactcaagcgctggtgcaattacactccacacgatgtgacagttcattatgataacctgtttagatacatatatttgaaaattaaaataacttgaaaattttgatttagataatcagtttacaatcaatatttttaacggataaacagaggaaatatgttttgaagtcattgctatatattattttttcaaactttttttaaaaataaattttttatgataaaaaaaagaatttaagaagactaaaaaactctaggatttatatgatgaaaatcttctaagttattaatttaacttgtttattaagtaaattttatccctcaacacatttattcttacttgtaatacttaaattagaaaaacatattaacaaataccaaagccactttacttaaatttttctttttaagctggtatcaaatttataaaagtggcatttttgaggggatttaacattattaaaaacagaaatatcttcattagaatttcctttatgaagaatataacaattggaattaaatttgatacgattattttatataattaataaaaaagtactttttttatcaatgttttggttttctcttgttaaaataaacttctatttccatgattttattttataagtcttttcttttaaatgcgttcacctattttcttaaatgttaaaaaatgaaaatattcgatttatgtttcattgattaatttctaaataaaattgattatatttattagctataataataaatcatatcattctccaaaaacttagatgaaacataatatttttaaatcgtcatattattttaaatttcttttataatgttttttggtgcataaatttttaaacgttcaccaatcttgaatgctaagaaggaaaggaggaaaactaaaaaaattcgaattttctgattcaactgattctgaatactctctttccgattcaattagtcatggtgaagatggtaatcctaatataatagaatctgaatcaagtgaaaatcccatttcaagtcctcaattcattacagatgctaatttatataattcaccagatcgaaaactatggacgtccaaatccgaaattaatatcaaagattcaagtcatttaacagatcacattaatataaaacatactttccactggttttctggtgtctttattcctgtattttataatcttctatgtgttacatatttccttgatttacatcgtacgatttcaaacattggttggggctatagtcttctttttcattttattaccacatgtgtttccattggaacacttacaagtatttgtgttattgccactaatggagaaatgaaagaaggcggatgttattatttattatcacgtacacttggtcccgaaattggggctgccattggtattactattgttatagcgcattctacctctgtatctcttcgattacattatgtttctcttcttatcacaaatttttattcatcgaaaccacttttgtcatcactttattgggatcgcgttttatggcaatttcttttaaacatcattgttttatttttaggccttccttcgatcaaatttatcataatttttctgatgacattatcgccaattttattaatttctattgttagtaattttttagggttttttattcgtaagcctggtgatccaacatattttactgggttatctactgaaacattaataaaaaattttaatcattcgataaataatgtttggcaaatattacaatttttaggtgttttatttcctgcgtcaaatgcagtaatgacatgtgcgaattttagtggaaatttaaggaacactggtaaatctatacctattggagctttttctgctatttttttatcagttttaatcatattgataacaattttattacaatcatcatcatttaatataacaagtgatgaaagttttttgtttattaataactcagctgtaccaattttaggttatattggttttatttgttcatcaatttgttcatcaattacaatgaacactggtggcacacgtatattaataacattaataaatgataaattattacccaaatttttaaagaagataaaaatcaagaacgaatttttaagttgtcatttaatagttactataatatcattattattttcgtttatagataatccaacgttattaacgcaaattacaaatattatatttttgataccattttcatttatcaatcttacagtatatattgctgattcagcacattatccaggatttagaccttcttttacattttataatcgatatgtttcattgtttttatcgatcatctgtatcattcgtatgtttttaataaaatgggaatattcattaatttttattatcatatttataatcatttggtacatatataagcgattaaaacttaatgataattggggtactgttactcaatcacatatcttttattcgacttataaagaagaattaaatttatatcatattaaacctcatgtaaaaacatatcgaccgaatttaatattaatcacattattacatcctgatttaatacggaacacaattgattttattaatgaattattgaatggccatggaatggtatctgttggccgtatatttataactaataattatttaaatgattataactttaataagttaatagaagaacgtgatggtacttatttaacagatgattataattatcatacattttatgatataactatatctaaaacttttgttgaggggttacaagacttattattattaatgggaataggaatgatgagacctaatacattatgtttaatttatccaaagttttggtatgataatgaaaatgtaattaattataataattataatgaatttatcgatgctattaaatatgctatgaatacgaaatattcgatttgtatcttaagaaacatcgaattaatatctgaaattaataacaataaaaagaatatcgatgtttggtggctatttgatgatggaggattaactttgttactttcatatttattattaaagaataaaaaatggaaaaatttgaatttacgtgtaataaaaattatgaaaattaatggagaaaatgaaaacgaaatcattaaactattatataaatttcgtattaatgcagaaattattataatcgatgaaaatgatttaaatatttcaaagtgtactttggataaatggaatgaattaatgaaaaaaattaattataataatataaatgaaatggatataatgaataataaatgtttaatattaactgatctgattaagaagtatagctctgacgcagctttcatcgctttgacattggaaatcccaaatgaaaatttggataacgacatttacatgtcgtggatggaaatgataagtgatattgacatcccgtttatgtttataagaggtaacggcgaaaatactttaagttggactgtgtaaataaattttcaaatattatttagaaataaaaaattattaaatatttattttaatgaacaaagaaattattcaatttaaaggattaaatattcattcattatcatttggtactaatgattcatatcttaaagctatggaacctaaaattattaagatattaccattagttgaaaaatcttatgcaattcatggtaagattagtcctgaattattaaagtcattaacagaacttcgaacagatttaattacaatcattaataaagaaactaagaatccttatgaattaattgaaaaacttaagacagctacagatgtccaaaaagttatttctaattctatgcaaaagattggtgtatctacaaagaatttaattgaatcagtccaaaatagaaataaatcatctaaaactcaagcaattgcagaaatcattgaatatgtctctaattctatagcagctatattccaaaggattaaaatgttacatcatgtgaaaatgattcgatttataatgattgtattagaatattcgattcttctttaatatcagtacgttcaatgattgatatccttaagacttctgcagtttcttctacttctattcgtagatctacacgttcatttaatagaatgtttgattcgatgcttgatattatggaagatactaatatcccaatttataaacaaaagcctacatcagatatcggtaaatctaaattagaattcatgagaattgcttctgatgtaattaaatcattatcttcaactattacagctagagcagaatctaaaatccccgaaacatttgaattcacaagtcgaaaaaaattagagaaatctatgaaagaattagaaactaaaatcaactaaattattacaattaaatactgataaacaagcagagaaagaatttaataatttatttgttactattaaagaacaatttggacaattcaaagctaatgctaaaaatccaacattaaacaaaacaagattcggcattatttgatttaactcatgacttcattaacttaagtgattcatttggtgggttaacacgtgttattaataagttaactgatgctgtacctatagtacctgatttagaaaatgccgaaaaacttaagaaacgttatgtaatgccatcagtacctaaagacactgctaatttgaaagttattgattcagttaagaagttaaatgaatatattaatatttatcaacaaaagtctaaagcattttatggattattccctaatgcaaagaatgcacaattagcagattcaatgaacgaagtatatacagctatagataatgtcgtattacaaacattaagagtttcagctatatcgatgaacttagaattgcaaagtggtttagcaactacttgtagtaacattgcagtaaattatgattcattacttaaggaattacgtagtagattcatgttaagtggtgattgggatggacaatcaccgaaatatagagaaaacattaagaacgcaattgaagagacacagaaaatcgcgcaaaaggcattagaaatagccgaagaagaagctaaagcacaaaaatgcagttaacgctaagttcactaatgtattaaatccattaacacaagttaaatcatcattagaaacttataatgataaagtcaagacaatgaagtcaagtatctcacgtgaatatgctacaaacatgttaggaattggtatcactttatgcgactctgtaaatcatgttgtgttacatgcgaaggcacatccaagtagtgaagaaagcgtcgatagttatctttcattaactgaagaagtaactgaacaaatgaaattattactcgacgcgtcaactaaaattacttcacaagaaaagaaagtcgaagaacccgaaactttagtcatcgacagaatgaaaggattaaatggaatcggagagaaattcgcaaagccgcataacaatgagtcacctgaagcaaaggcactgagagaaggcgtagtggtaatatgtaaaggtgcaaacgcattagcaaactccgcagaaactgctttgaacaataagagagaacaaaggaagaaacaagaagaagctgcaaagaagggcggcgctgtcgtgagagttggaacaacaaaggaaagtttgctcaagagattggagctcgagtcaagagtcattagagcacgtatcatactcgagaagtctgagaagaatctcgctgaacttggatgaaatgaggagaaaatttaactaaaaaattaattaaaattactgtgatgttttatacagaagaatatggaaacatttggaaaggtcatcagatgcgtcctcatgtaattacttctttaatataaacttcgcaagcaaatatattattctggacatgagtttccaaatatttggtgtgaaacttgtataatttacatggagaaaaacgacaaaaagtgcaaacgttgtacagttgtgtaatgctttgaaatgatgctgtaaacagctgccgatggatttttctatagaacgataatgaattttgagtgaaaagttttcttgcattgaattaccttatttacagtttggacaatcctggtgtttctgtttttcttcctttctctaactgaaattactcgtttcagtacttggtgtaatggcatttcaacaggagattgcgaaactgaactccaacaaacagataatgaatttttctttttcacatattggtgaaaaagattattctgttacatcacctcgtatctcatggcatcctggtgatgaagtaactgttactggcgatgttttttatataaaaggagatgctaaatttcaaatcattccatacgattttaataatgaaccagattggtcatttcaatcttatccagttgttgattcacctggcgaatatactacatatactagaaaatggattattccaggaaattcacgtaatttcacatttcgtttttgtcggaagtaatattaccaattttaagtttaaatctataaagtgggatataactggtcactacgatgcacccacaattcgaaatgtcgaacttgaaaattcaaacatcaaattaacatatgatactcttttattaaatatgacaatttatgataaaaccactcaacgaacttgactcaacgtagacaaactattggtggcactacaataaatttaaaaacgaccagtagttcaatttctattgatacaattacaccagataatcttattcactttaatattgaacttttagaggatggatttcgatctacagttgctcttgataacaatgactccgaaattcttccaccagattatccgtttccatttatctcttcacttggagatcgtattgtacttccatactgtgaaggcatcacacttcctgttgatttaaccgaacttcttggacgtgatgaattttattatagtatttatagtttatcaatgggatttgttggtcaaacaaatgatcaaagttcaatgataataatatttgaaacgccttatgatagttcagtagccgttgtccgttataatgaagaatatttatatattaaaccacgatttagtcttgagaaaggccgtttttcatatcctcgaaaacttcgttatgtctttttagaaggaaatcatgtttctatagccaaaagatatcgaaaatatgcgcaagaaaaaggatatttagtaccatttacagagaaaattaaaactcgtccaaacgttgataaattaattggctcagttaatgtatggactgttggtagttttaatattaataaaatcaaattatataccgaaatgcaatcgttaggaatcgaacgaatattatcatcaggtggaggatcaatcagtgaagttaattatatgaataataatatgactaatatcctttcaagtcgatatgatatttatcaagatcaaatggatcccgaaaatattatcaaaggttatgtaagtaattcgacagcatatttttatgatgcatttcctgatgatgttattgttgatgaaaataatcaaataattacttcatggtcagtaaataatttatcatgtccagcaggttcaacacttgaagaatgtccacgagttggttgtccagtattatgtgacttaagagcgcctgaatatgcaaagaagaaacttgataaagaaatttcttctggttataacttcacaacacgatttattgatacgacattttgcatcaccttatcgtgaatgttatcatccagatcatcctatgactcgaacaatgtcattagaagcacgaatcgaacttttaaaggaatatacaaatcgtggatttgttgtaggaacagagaatggtaaagaacaagctatacctaattgcgatttctttgaaggaatgatgagtcctggcgaatatagagtacctaactctggaagagatttagaaacagtgtttacttatgttcctgaagaaactcaatatatggttgatgaaactttacgaattcctttgttcgaacttgtttatcatgattgtgttataagttattggtattggggagatcataattcgaaagtaattcctcaatgggataaaagagatttgtttaatcgattatatggaactccgccaatgtttttgtgtttaatcaaacaatttgggaaagatataaaaaaatagattcgttcaatcttataaaactgcagaagaaatttcttatttaactggatattatgaaatgactgatcataaatatttgtctgatgattggaaaagtacaacaaacagtgttcggtaataatagggttattgtcaccgtaaatttcggtgataaaaaattcggaggtattgaaccaatgagtagtactgtcgtcgtttatacagatgcacctccttgggcaattgctgtaattgtaattgctgctgtggtaattgatggaataacttttcttgtcctttttataatgaatagaaaaaaaggtgaagaaaaagactccaatgaagattaaaaataatgtgacttaaataaatattaatataaatgatggaaatttctgtatttaacagatcacattaatataaaacatactttccactggttttctggtgtctttattcctgtattttataatcttctatgtgttacatattttcttgctttacatcgtacaatttcaaacattggttggggctatagtcttctttttattttattaccacatgtgtttccattggaacacttacaagtatttgtgttattgccactaatggagaaatgaaagaaggcggatgttattatttattatcacgtacacttggtcccgaaattggggctgccattggtattactattgttatagcgcattctacctctgtatctcttcgattacattatgtttctcttcttatcacaaatttttattcatcaaaaccacttttgtcgtcactttattgggatcgcgttttatggcaatttcttttaattagcccctttttcatttagtaatttaactatttctgtatgaccatttgaagatgcacaaataagtgctgtatcaaataatttatataatttccaaatattattttgaaatatcaaattattaaaataaatattaaataaaacaaataaatagatttagcattaatatcaattccttcttgttcaagaagtaatttaactatttctgtatgaccatttgaagatgcacaaataagtgctgttctaaataatttatataatttccaaatattattttgaaatattaaattattaaaataaatattaaataaaaacaaataaatatcctgagcattaatatcaattcctttttgttcaagaagtaacttaactatttctgtacgaccattataagatgcataaataagtgctgttctaaataatttaaataatttccaaatattatttgtaaatataaaattattaaaataaatattaaataaaacaaataaatatttttagcattaatatcaattccttcttgttcaagaagtaatttaactatttcggcgtaaccaaattcagatgcacaaataagtgctgtataaattaatttacataatttccagatattattttaaattatcaaattattgaaattaatatcaaacaaaataaataaatatctttaacattaatatcaattccttcttgatttaaaagatattcaacgagttcaatgttccctaattcgggagagtatgcaaaaatattttttggaattggattttctttcagaaaatacttaatgagataaagatttccaatttttaccatattattgagaatattttcatttatttttcattccatttttctgtaaaaaaacataaaaacttcaatgttcaaaaacataatacatagagagcctaatttttctatatcatcaatttcgataattttattttcataaagataattaaaaatatcatttcgatgaaattcaattgctgtttcatatgcatctttaaatgatgaatgattttgttcacataaatgaacaatttcaatgtttccacctgcaattgcatatttacctgtgttttccacatctgcaccattcataagtaaatatttaaaacatttaattgaagaaaaaaatgctgcataatcaattaatgaaacattttcttcattaataaatgaacatctttcataaagtgatggtttaattttttgattaaaatcaaattttggttgtgatgttatttcttgaagtttttcaatttcatcatttcgaattatttttgcaatttcatttggattatgtccttcttcaatatatttcttatgaagttcccaatcattctttgataattcttcataattagcaatgatttggttaaaagagctaaaatttttttgtttataaatttcttctttagacatataatggataaaatatggatttttctcatcttacaatatttttagatcaagaatattattttcatacattttcaaaagtggataatataatttttgcttgtaaattcctgtgtaatttggatcgaggtcaataaattttgcaaaaagaaggaaattagtaaaaacatcaaaaattttagatttgactttattggtttcttgaaatttttcaatttctttcataaaattcaaatatatatcgaaatcattcttttcaataaaaacacagataataacataatgactcataacaatattaaatgaatatggataactataatcaaatatggaaataattgattgagctgcttgagaaatattttctttatttaaaccaaatatgatttgttgaattgatttaatgattttcatttcttttgttcctggtttttgattgttttcttgtaagttactctttttctccaacatgaaacaaaaaaaaatgtcagttttaactcccctcaaatcaatttgccacacatcatctcatataaatagattttatcaaagggctatgaaatgtaaagggaaataggctgagaaaaaaattattacgtttacaagctatcatttatttatggtaatctttaattaaaaatttcttgagtgtaaaagcaaaattttttatagacattataaagcattaatttaattattttttttttcattctttgtgtggaatatataatataacaatgtaaagctaatagagcaaatgcaagtatttctttccattctagaattaataatacaactactgaaagtcttaaacctacacatcatatgtaaataaggtgctccccaacctgatacttgtatctttaaagcgaagactaaaaaaaaaacataaattttcaaaataatttttaaatataaaatctcataaatgtaagtattataacaataatagatctttaataaataataaaacttttattgaggagttacaagatttataacaaaataaataatattacgacaaaaatgtcactcataaaaaaaagtaaatacaataagcgatggtttacatagcaacatattaaaagttaatttatcttcataatgttttatatgttacgctgaaagttgtttttctttatcctgaggacaactacaaaacggacacaaaataagaattacatccagtacaaatgaaatgacatataaataaaagaacgcttcgatgcttgagtgatatttattacatgtttctttatcaaatcgcaatgtttgtgtttggatatttctgatgcttgaacacttatttggtgctgaataagcaaaacagcatatatctgatgataaattgaataatagaattaaaaataatataaataaataaatgtggtatatcctaccagggattttttgacggattttgattggaataatcaagaaaattataataaaaaaggcaagaacaattggtgacacccatgaaatagtagtcataacatataaaatatacaagttgtaactaatgttttcagaatctattgagtaatcatatctaattttactccaatgtattccagacaaaatagtaaatgcaatgcaacaaatgataattactaaaataagtataaaaataataacaaaatatgaaagaaaaatagcgctttcagtaggtgaaaatgtaatactcatttcgaaaaactttgaacataactgaaaaaatcacatttcatgtaaaacaaactataacaaaaaaatagatagtaggcataagttaagcaatgaacacaaattacaaagatttgtaaaacatgagtcctattatgctttgttgcaaaaaattcttatcaaaagtatttttttttatcataatatccaatatgaatttcaagaataaatgttttaaaacaaaataatttttaaatctcattttgaaatactgtcaatattttaaattcactaagcaattttatatcaaggaaaatgttagtgaacatttattttgtcatgtactccaagtgtgttattttcatccatgttaaaagtaattttttgtgtttccgacaagtaaacttcaaagcaattttttacagatgctaagaaagaagaaaaaattgatcttttattaaaacttacttacatatgcaagtgtatatttcgtcactaaaacatattcaacaaaaaatcagaaattttatttaccaaatcgtgcattcaggggtcatattaagtttttcctgatagaaattcatcttttcttcggaaggtgccactccaaaatcgccttctgaatacactcttattaattctatcaaagcgaatcgatcattctgctttgcgccatttttccaaaaatttccaaaaattcgttcattatttggtgggttttcatttcttcatcttgtgaataaagtacacctaaattataaattgcatttaaatgtccttttttagcagcagcttcataatactcggatgctttatttaaatccttttcgactccttttccataatgatacataacacctaaattagttaatgcttgaacatggttattacttgctgctttttgcttttcggattacgtggcacaaaatgtcctggtgtattaactaataaatttgctaagttatacattgaacgtgtatgattttttaagattgcttcttcataacattcaacagacctttgaataagactcgtgttcttcccaatatattcataatattctcctaatgaacataatgcatcaggattcttagttttggctgattcaactaaaattcttccacatttccctaaatctggtggaatctctttaaccatcgcgataaagcatcgcaagtcttattgtgcaattaaaataccctttttctgatcctgtttctaataattcaattgctttttgacaatcatagggaacattttctccacttaaatattgtaatgcaagattatatatagaatgagcaaaacccttttgtgctgatgtttcgagtaactcaataccacgtggaatattttttggaaccccattacctacaatataaatcatcgctaaattaaacatagctgtaagatcgtcatttaagacacatttctcatataagttgacggcttttgggatatcaattggattacctcccaaaccgatatgataaatttgtgcaagattaaatgatgcatcatttattcctgcatcagaccctttttggaaatattcaatcgctttattgatatcatgttcaataccttctcctcttaagaacaaattaccaagatccatatatatttgtggattttcttttgcttgttcttcaatttgggataagttctctttaattttggaaaaatcagtcataaaattttgtttggcaaatctttttttattgaatagtttacatataggatttcagaatgttgtgtgatgtgatgtttgaattgcttcaaaatttacccaaaccgttaaaaacaatgaaaaagccgatacatatcgtgagtgaagacaaaccataaaaaagtgaagaagcaaaaacaattaaatgatatcgaaattcatcaatcaatcatgcaaaccctctttaggttggctaaaacaaatattatagaatcagcaaattcaataattgacatttatgatgaaaatcatcctatttcattcaattttatattagtccaaacaatatatacaatttccatgttcagaatgaatgactttgatatttattcaaactttttaaaacaaattgaaatatttgaagaaaacaacaaaattaaatcaaaaatttttgatgtatttgaaggtatacttctttctaaatattcagaagaatcaaagtatattctttattatctttttgaaaataaatttcttcagagtccaaaggttgattataaaagaaccaatgaatgttttgcacaccacatgacgcaagaagaaattaatgaatattattgctatggaattaaacagtatataaaaaaacattatgaagaactttcaaagaatgattgggaacttcataagaaatatattgaagaaggacataatccaaatgaaataacaaaaataattcgaaacgatgaaattgaaaaacttcaagaaatatcatcacaaaatgattttgattttaatcaaataattgaaccatcagtttatgaaagatgtgattttattaatcaatatcggattacattaattgaatatgcagcatttttttcttcaattaaatgttttaaatatttacttatgaatggtgcaaatgtagaaaacacaggtaaatatgcaattgcaggtggaaacattgaaattattcatttatgtgaacaaaatcattcatcatttaaaaatgcatatgaaacagcaattaaatttcatcgaaatgatatctttaaatatctttatgaaaacaaattagaagatatcaaaaatttgggatttttaggaaagaaatgtatcaaatggaacaactatgaactctttacatatttgcaaaaagaaggaatggagattaacgatgatattattaatgcagctgcaagaattggaaatatatatctcacaaaatattttatgaaagagcatcacacgccaaaagatattttaggttattcatctaaatcaggaaatattgaacttgtaaaatacattttagatcaagaaggaactgatattaatgctgaagatattcatttgttttaattgaaatttaatttaataatttgatatttcaaaatactatttggaaattatttaaaatatttgaaacagcacttatgaaagcatctgttaaaggtcatacagaaatagttaaatatcttcttgaacaaaaaggaattgatattaatgctaaaaatatttttttattttatttgaaatttattttaataattttcgattttaaaataatatttggaaattatttaaattaaatagttcagcacttatttttgcatcttggaatagtcatgtagaaatagttaaattacttcttgaacaaaaaggaattgatattaatgttcaaaatctttagctgttttgtttgatatttgttttgataatttggaatttcaaaataatatttggaaattattataatgattttatacagcacttatttgggcatcttcaactggttgtacagaaatagttaaattacttcttgaacaaaaaggaattgatattaatgcaaaaggtatttatttgttttatttagaatttattttaataatttaaaatttcaaaataatatttggaaattatttaaattattttggacagcacttatgttagcatcttattatggtcatacagaaatagttaagttacttcttgaacaagaaggaattgatattaatgctaaagatatttatttgttttatttagaatttctttgaataatttaatatttcaaaataatatttggaaatcatttaaactatttgatacagcacttatattagcatcttataatggttatacagaaatagttaaattactaaatgaaaaaggagataattaaaagaaattgctataaaacgcgatcccaataaagtgatgacaaagtgggcaatctaattagatttgtttcaaacacacgaggataatttagatttgaagaaaaagaaaataatcatcaaataaaaaattttgaaaaatatgttttataggaaatttgtatcatcaatcaataatgaaaatgaagtctttttattacactttttgataatcaattaaattatttacaaatgaatttcattaaattcgtcagtccatcctaaagcatcaattatttgtttgcatatttcttcgcaatcgccctgaaggaaaatatctcttcgatttgtaacatgaccgaacttaaacagttctttatgactattctcagctaaatcgaccaaaacatttcgtctttcgtcgacgctgactttttcttcatatgtcgcaacaggttctttattaatcaaaactcgaagacaatcttttcgacaatatccaggaagtaatgagcatggagtaactttcagtgacgtaccaataacaataagaaggtccgcagatgcaaagtcatttggataaagatgataaaatcgctttggaagtgattcaccaaataatacggaatcaggtttaacaacccctatcccacattttttgcaataaacaactttgcctgtcttgaactcttcgaggtaatcttcgtgtttagatttatcgccacaatttcgacatgtattggtggaataagttccatgacattcaactaatttatcttcagaaactcctgctttccgatcgaggccatctacattttgcgtgtaaagtcgtaaaagaagatcatgcctgtcaaataatgttgccatgtaatgtggtgcaacgggtttaaagtctccactaagaaaaggttgcttaatttcaaaaaacggtgctggattattgtcaaaataatcaatagagaatggtgcttcgggatatggcaaattatatttttcaagatttgaataaacgcctgtgccaggtgacctaaagtcagggattcctgcggcaacagaagcaccagcgcctgttagaaaaacagtattttgagcaaatccatttttgatataagaaataagaccatcaaaatctaacgaactcaaccctttgataagttttggtttcattgggtgagtcatttttggagagactttggtgtaattaaacatgaatgtttgctttgttaccaaagatataaaaatcggttattttgtatggaaattattcggcgtttctaaacttttgatcatttcgtgtatgagaagtatacaagtgtttaatactcatgaatattttgtgttatatgtacaataagtaataaagatagtaaatattatttatttgttagcaaaatacaacttcatgtaattctgaatatatcattagactataagaagatataataataattcagaacatttaaattaaatcaatctgattagacatgtctaaagcgaaaaagaaaattttatttcaacggcaaaaaattatattttattcacctgaaacattttttttgatgtcgtttctttttaatcgtctcgaaaaagaaataaccaacgaaaagaagcctattcccgatctccacggtgttccatttggttcaattttcactgatcatatgctcattgccacatacgaccacgagtggaaatcaataaaaatagtaccattttcaaacatttctttacctccgcaagcttcaattttccactatggcactggaatctttgagggtctaaaagcgtttcgtgatttgcaaggcaaagtccgtcttttccgacctgacatgaattgcgttcgctttgctaacagcgcgaaacgaatggctcttccagcgcctgatcctgacgaattaatgaagtgcattattgaacttgtgcgcgttgatgaacgttgggttccatatgaagaaggatactcgctttacattcgcccaacaatgattgggacaacgccatcacttggactgaagaaatgcgaccaatgccttctgtacatcatcttatctcctgtcgggcattattacacaacaggtttcaagccaatttcgctctgggcatgcaatgagtattgtcgcgcttggccaggaggtacaggtaacttcaaagtcgcaccaaactatggtataactgttatgcctggagaaattgcgcatgaaaagaattgccagcaagtgctttggttgtatgggaaagaagaatatattacagaagtcggatcgatgaacattatgggagtttggataaacgaaaatggtgaaaaggaactcgtaacagcaccggtttcgaaacatctcattcttccaggtgttacaagggattcagttctggagttggcgcgtatggaaaaggacataaaagttagcgaagaagaatggaaaataggtgacttaattaaggcgctaaatgaaaagagagtacttgaagtatttggtactggaactgctgcaattatttcacctgtaaataagattatctataacgataaatgttatgatatcccagtggatttggataatccaaatgcaacaattgggccatttgctcatatgatttatgataaacttcgcaacatacaatatggtgttgtgaatcataaatggtctgtgcttatttaaataattaagtttactagaataagaagagtaaaactcgttttgagcactgtaaaattgaattgtttatgatcgtttcattgtttttgaaaacatgaagtgacttaacgttccccatatttaaaacaaatttatctttattccaaatatgttatttgagtttatacaaaatatttgcatcaacatacattacatattgttatattcatatttatatcgaattttataggacaaatgataagaaatttggattttttgtttaaagcgtcagttttttacttcacctaagccatttctatttgaaatcaaaaatgccagatttctatctgaaatcaaaaatgcctttttagtgaattcactaaaatactttttatggatattcctccgccaccaccaccaccaagcccattagttttacagcttgttcctgatgaagcgattaaaattgaaaagttgtttttagaattaaatgaaaataatctcgaaataatttctcacaaagtttcaaaagtattagaagttcagccaaaatgttctctactttatgagttttatatcacacagtgtatttatatgtcttattctacacaaaataaagatgcaagtctatacattttatttttaaatttgttatcaaacacaaaaaatttaagtttttcaaaattgcttaatgtgttaactatttatctttaccaaataaagacaaatgaatcagaatgtcttcttaacgaaatgaacaaacaaaaaatgataccttcaaatcttttttattatgtgaaaagaattgtaaataaagaaaaccaagaaaatcaaaaagaaaatcatatattggagattcttcgaaatgataatattgaagaattacaagaaatgtcagcacaaaataaatttgattttaatcaaacaattgaaccatcaccttctgaaaaaagttcatttgttaatcataaaaatgtttcattaattgattatgcagcattttttaaatcaattaaatgttttaagtttttattaattaatggatcaaatgttgaaaatacattaaaatatgcaattgcaggcggaaatttagaaattatccatttatgcatacaaaataattcgacaattagcaatgtattagaaacagcaattcaatttcatcgaaatgacgttttttattatttttatgatgaaagaaaccaaagatttgtagaaagaaaatacttcatcattgataaagatttaaataaattaggaatacaatgtttaaaatacatcaactatgaaattttatcgtttctagcgaaagaaggtttatcaaaattaagtctttcacttcaagctgcagtaataagttttaataatcttccatttatacatttattttttgaaggaaaacttatcaaaaacgaacttttttttgatctgcttaataatggaaaccctatagtagtaaaatggcttattaaacaaaaaggaattaagattgaaaatgaagatgttaaattatatgattgtatgtgattaatatttatttgaaatttttctgaattttttgaaaaaacatttttttgggcatcaaagaataatcatgtacaattatttaaacactttttaaaacatggaattgatattaatgctaaagatattcatttgtttagtttgaaatttaaactaatcatttgatatttcaacataatatttggaaattgttttaattagatgatacagcacttattttcgcatctgaaaatggtgaaatagaaatagttaaattacttcttgaacaagaaggactcaatattaatgctaaagatattcatttgttttatttgatatttattttaataatttcttgtttcaaaataatatttctagatcatgtgtaatatttcaaacagcgcttatgaaggcatctataagtggtaatttagaagtagttaaattacttcttgaacaagaaggaattgatattaatgctaaagatatttatttgttttatttagaatttgttttgataatttaatatttcaaaataatatttggaaattatttaaattatttaaaacagcactcattttagcatctcaaaatggtcatacagaaatagctaaattacttcttgaacaaaaaggaattaagattagtgctcaagatatttatttatcttgtttatatttatactaaacagtctttagtaaagatatttttcttttgaattgtttaataagctttatcatttaattatttaaaaattcaaatatatcgaataacttaagagaaggctccctgcttcaagtgttctattatgctaccaatttattatcatttatcaatttttttttgttattttaaagaaacgaatgatcatgtgtagtttgatataatcattgatatgattttttaaaaaataaaaaaaaaataatgaaaaataatatattttataaaaaaaaatgcatgtaaaaattatagttttcaaaaataatagaaaatattacaaacatgaggtgagctggtcgttattagatgcaaaatacgctcctgttagcgatgttcttgccaacagctttgataatacatacttagtgcctaggacgcattcagcagatgtttagttgaatttgtccacacataaataaaaaggtattacacacttttactaatcgttaacctcctgaaaaatgctgtatttcgttcagatgtttatgtttttttgatttcttttgtactgttctcaaacccaaacaataattacaattccgaaatgattcattcactgcataaaaaaatgatttttattaataaaaataccattccaaacagagaaaacgcgctcactcattatccttcccatacatttccatattttctttcagcttatcctcaatgtcagcgaatattttcattcctcgttcgctgaacacatatacctcagtcagcagcgggtacacgagtgagcatagtctgcatgaagtgccttcgcccatcactgcatccgcaagcgcttcggtgaagtcgtcgtagaggctctgtatgttcggatctatcactggatcggggttttcgtacttctcgcagtgcaaactgtcgatttccaaatgcctcaaacttgtgttctcgtgtaacgattcgacaatttctttggcgtcaactggagtgatatagcccgtcatccgtaagtcctcgagaacacattcttgcgttcgtaagagtgatgcgatgctactaaaaaattgatgatgttgatcttcatttaattgatgtgtttcaaatgagagagaaatgttcttaagagggagaagtggaagagagaaaatgcggtcatagcctgaatctgtgatttttgtttcataaagattaattgattcaagttgcgattgagagatatattgaagaagatattcgacggattcatcagtaatgccattattatcacttaaatcgatgctcttaaggttatggccgtcgatgctgttgatgattttggataaaatttcatcgtcaatttgacactgactcaaattcaaaatttcaatttgacggttatttgatgcggtggtgtgattgatgatgtggccgatgaagaacgcgttgtgcactgtgatgctatcgcgccattgcataatggtatctggactttcatacgtggattcaggaaaatgatatatccaacaatcattagttcgaccaaaatctttaaaactaattgttaaaggttcttggcgaagtctttcaagagttgacttgactttataaagttgatctagattcataaagccaagtcgaagatcttctatcgtttggaattctgataaagatgataaaaagatatcaaaatatgttgtccataaggtatcaggaacttcgggtcaagagattggaataggttggaaattaaggctttccaagataagagttcttaattttgtttttggaagtgacgaaataaaagttggaaaatctttttcagaaactttacatccactgatactaatggcttgtatgttatcaaaatctaccaacaagctagtgaggttttttaagtcaaccacgttataacttaaatctaatgcagtgatagtactacctcgaacagctttaatgatattatttgtcccttcactccatatttcattgtcagcgatactgagtaaggttaagtttgatgctggtataatatttgcaacttctgttgccccataatcaaataaagaatttgactctaaccgtaaatcggttatttttgaatcctttgaaattccttttacaattgaaatgcacccttttgatgaaatgtcgcatccacacaagcttaagagttgaagaggtggatttttctgtaatgactcaccaagcttttgacaactttcgtcgtaaaaaatattatcatctgcataaaattcaagaattgatgaatctccaagagcttcaaaaattatatcagaagagcgcctaactaaatgggtttctgtaagatttaagtaaagtaaagtcttgctctctatcattaagtttgataaaagttctgctgattcataattaacatgatttgtagaaagattaattaaaactagattcggatttaggcttttttgaattcgctcaaatgtgactgctgcccaaaatgattggtttgaaagatcaaattcttgggaagtaatttccattcttccgaatagaacaaactttgtcagcccataaaagaacgtttattctgcacacaattaataagtacgttaacgattttgctcattaaactatttcattcttcataaaactaaaattaaaccctttttctcattcatttcccaatgtttttcaacaataaaacgcatttctgatcaatgaacccaaaacaaatcatcaaattgatattatgaaattttattcaaattcaaagaaaacaaattctagggtttgtactactataatttattgaacattattaaaacattagcggattttcctccaagtgttcaatccattgaaatctttgtatttcactttcatttaagaaatgatcttcaactttcaccgttttcttttgtccgcgcaaagcgattttatcagcaaatcttatgtacgttgggctttcttcatcgtttatttgtttttgagattcgaatttcaaattcaaaacattcttcaacatttccactaatgattgggcgtatttaattccatcttcgaacaatacgaagtaacgtttcgattgatcatcatcaaaagggttatgataaatatatgtgtaaacgattcctttttcatttttataatataatgaaaaagcgttcactacttctgttgaagggtttaacatccaatcgttgacgttaataatttgtttataaataggtgaaaaccaacttacgaaattagctttcgattgattaacattttggtcgaaatatgataactctttaattgtttgaaggaaatcatttttgtacccatagcgtatgaaaaactcaacaaaggtatcaaatgttaaaatatctgattcttgatttcctaagatatataccaagttacgcttaagctgctctttgatttcttccgtaatggtcatcgtttgtttgtttattaaataggaaataaaaagatttaatgatgtttcgggaattgcacatatttccgatttccatgtgttagcaagtgagataaccaggttagaaaacaactgttggtttaaatggatttgattaagtgatttaaatgaagtatagattttgcataacgaattttgtatttgtgcacaattaatacctgtgtttaagaaggacttaatcagttcttttggtatgggaaaaggaaaggaaattttttgtgcaggtaatgggcataatgatgtcggtaaaatatttgcacattcgagtgttgtttgtgaagaaaaatctaacgttaaatgaacacggattttccagtggcttatgtctgggattcctggaaattgtgttcgcatctgtgcagttccatttgggaatatactaaatccatgatctcgaaaatttgtgttaatagagttaacttttaacttcatgagctcacttaaaattcgtgagttggtgatgaaatgcttaccatctgccatccatgatcctcctgttttattgatcaattcaggatgttctttggtgaagttaagaattgcaagaattttcacaataaattttgtccttgttgttgcgctatcccttgttacaaaagcttggagttcttgcaatgtttgggcccacttcataaccaatgagaaaccagttcaaatttaccccaaattggattgaatacactgaaaatttgtgtttgaattgtgcaaaaccgtaaatttcgctttaaaatttcgatagattaggaatcgtctcataaagcagttccttttactaggttgtcacgatgtatgcaattactcaaaaaacgaaatgggctactaaaaggcgctaataatgttaagtcaaagccaacaaaatccttgacaaaaaaacaatatattattcaacaaagatgtcaaaaattcatgaatcaatgtaattatagcacaggtctaattaaatgattgataggtttaggacaaacacaaattaattgttctattagatgactttctgtcagatctttcaattcatatatcatcatatcaattgttatatgttttttccaaaaaaacaaataacatgggcttcaatgtaaccttctttaatcaggatgatgggtaattatatatacttttcaaatatttatcaataattaaattatatattttttcttgttttatcatataataaacagctaaaacagttaaaaatcattcgtaggaaagtaactataacgaaaagaacagctgatttcactcgaaaacaacacttacggaaaagcaaaaattcaatacataaacgaatttatcctattcaaattttctgatatcaaattttgattgaataaaaatttttattttgttggcattattgcagcttaaatgtaacggtagatgcggccaaagagcattttaacgaaaattatcatcaaatatttcataaaattttcaaacaaaatttgtatcaaaactcctattacccactgaataattctgtttataaccgtaggttctcgacaaaaaaatcaaattacctcaccaaattattttgattggcaataaaacaaattttaatcctcctgaacacatttaaacgaattacaaacacttaaccaaccaaagtatcattcatagccgttattaaaatgttgaaaattattcaaacaatttgcaaatcaaatcgtaattttatatgatatacattaactatatgcaagacaatccgagtaatttatgttatttttttgctttttgtcgataatacaaaatattttatttatattatcaaaatgcattttgcaccagcaatgaccacacagcaaaacatacaaattcatttatgcattaatatgttcataaaattgttattcaatttgttgaacatatttactataacaataattccaaacaacgaatttgacactgttggaacagaaacaaaagaaaatatactaaaagtgattgaaatggtttattcatgttatacaagtttacgtttacttaccacgtccgaaccaagagcgcttcttcagtttgcttgtttcgttgctttgtgtttgattcacacttgtgacgtttgcatcagttgtgatatttgtatccaatgttttattagtatttgtttggttgagttctgtcgtttgatttacgacttcttctttaacaacagtttggttaattgtttctgtaacatttgattcaggaagaattgtttcatttgaaattgtttgatttgatatattagcatcaattgtgacattaggtacagtaattgtttgattatcgataactgtatcattgtgagttgttacattgattacttctgtttgattttcaactattggaattgtttgatttgttacgttgacatcaagagttacattagctggaatcgtttcgttaacttcttctattgtctcattgataattatcaaaggctttgtttctgtaatattttcttcgacataattagaaatatttacaatcgcttgttcaacattctttacgggcttcttcttaattggctttggctttggtgtctcaatatgccttactttctttgaatgagcgcatatgtattccaatactgcaggatttgccaccgatacaacttttgacgcgttaaccgccaaataaccacttcggatcatttttcccacaatttttgcgttgtttctaacttttgatatgtttacccagggaacttcacctttggacacacaaaattggtaccaaactggatgatcaggttttatcatcaacttattcatctcatagtctattttttccttgactattttcattgagtcttcgaagctttcatatgtttgcatttcttcatatacatatgcaagtgatccgccatgtccgccgaactttttgatgatctccgctgcttcttgtgacgtaaataagcgattagtcacatggaccttttctaaagtgttttggattggagcagtaaatgcaaactcaaacatttcgccaagtcttttagatttaagactgtgaagagagtttgtaagctccacaacaaagggaacaaactcggaatattgcgcacgattaaggaggcgatgatatgttacattaaaaatgtgtgaaccaagtttgcgtccatcaattgttttaagttttggaagtttatcagcatggtatacaaagatatatggtttaactattgggttgaaacgggaaatgaggttaagaaagtcttctggttgagtaagaagagaatcagcagcatcttcaatgagatgataagcacgtgaaagacttaaatcagtgaaaagagttcgattgggcttagggataacagaaagagatccaagattttgtacttcactgggagataaaacttctgataataaagaaagactttttatagctgatattttgatggaatcaacaacctcttcaacagtgttagtattttcaacatgaacactaattggaagtcctttattgctgatgattttcttggaaagaatgtctaaaagtcgtgatttacctgttttatatggaccagtaacaataagaacatgatttgcaggatctcgtgagagatagttatgtacagaaatgtttaaatctctattccaaatgaatggaaaagttccagtctgacgaacaaattttggtttcctaaggataaagtagagaatgatggcaagaattaaaactattactggaataatatatcttaatgggctcttgcgttgttttgtagttgcatccattacttttttgaagagaccgttaaaaatgtattttcaacaaatgttctaataaacggtcgattttttataacagaaaacacgttacgtaatcagaagaaagaatgattcaaagcaatcctgaaacaaatgaaaaagaaaacaaatcagattcatcaagtaattctaaaagtagcaagtcctcaaaatcttcaaaaaatcaagaagaacaaaaaatttcaattcctcaaattattcctgctagtgaaaatatctctaacattattagcgatgatgaccaactagaacctgaaaaaaatacgcaacttagcaagtcatcttccaacaatgaattaactaataaaagtaattcaccaagtgacaaacaaaaagacaaggcttcatctatttcatctgataaggaaaatgaaaatgaatccaaagacttaacaacagataaacccaaagatatatcctcttcttcatcttcaagcaaagaaaatgtcatgcctattaaccacgctaataccacaggtgaacaaccgaaaccaatgcaaaacaataaatctgattctgatcattcatctgataatggaaatgaagaagcatctagtgatgaagccaatcccaccactgaggaaggtttagttgtatctgacaatgtacctccaataccgattcgtcgtgcacctccaccaccacgttattcaattgaagaattagacagagaacttaacaaattcattcaccccaaacgtggcaaaaaggccgaacaaattccacgagatatgcgacgtccacttttgcagcatttatcacgtcgcaaagtcgaagccattgagaaacaagactatgacaaaggcgaccaacttaacaccgctcttatcaacatccgtaaatcattacaaagttatactatgcaaacggatgcgcaaaacgagcaacaaattactcgcgcgcgtctacaagaagttcgtgaagaatattcacatatggaagatgaatgggatcatcgacttaaagagttacaacaaaaaatggacgaccaagagaaagaacttaaagagaaacaagaaaatgaaataaaaacatttactgatgaatggaatgatccgaaatcattaaacgaatttaataagccatcgccgattttgatacagattcggagcgtcgaaaagaatatggcattgacaggcgacttcaaaggcgcgaaagctatgaaaaaacgaggcgaagaactcgagaaaaaagaaacgcgcgaagcacaagcgaaagctgaagcttcaatgcgaagagcttatgcatgtttagaacgaaagcatcaaagagaattagaggcacataaaagattagcacataagatgaagttacaagcagagttaaagaaagaaagtgaacttcagccgtatataatggcaataaaaaagttggaaatgatggaaaagaaaacattaacacaaaaaagaccggcaactgcagtaatgagatcccgttgtatgaccgcgagaactcaaatgagattgccattggaagatagaccggcagtgtcaacgccaagaacaatgagaaagttggcaaacattagagcaacatcaaaagcggaaacgttaccgataaagaacgttaaggcaaacaacttcgtgaagacaacaagaatgaaacagaaaaagaaagacgacgaagagaaaaaagaagtggtgaaaaaaagatatacattttgattattttgttaaaaaccttttttgatatgataaattgttttgttacacttttttgttgaaggttttttcaaaatgtgttaaaaaagataattatgaaattttagcatttttggaagataaaggaattgttaatgctgataatataaacgaatcagcaagaaatggaaatttttatctccttaaatatttaattcttcaaaataatcaaattccaaaaatattttgccatttgcttcagaatcaggaaatattgaacttgtgaaatatgtttgagaacaaaaaggaattaatgttaatgcaaaaaatattcatttgaataatttgaaatatgttttaataatttggaatatgtttgatgatggtaataagtaacaaaagttagagtttatgtgaaaaaaaaataatttgccaatcatcaatgacttcatgtcttctttcacaatgttaacattatacaatccattacacgttttattttcaattattccgttttggtaagtccaaatgaagaaatttcattatgttattcctgatatatatttccccattcattacttattgatgatgtataatcattattcgaacgttcagtaattccttcaatttataataataagaagcattatgttagaaagtgaatatatgaactgagcttagtgaacgagcacgaataataataagtggagaacgtttgatttttttattgtacgattaaaatgcactcaaaaattttattaacagcgggtcgaagaaaaatgtcacattttttatgaagttaactgttcgagtggctgcttacgtttatcaaaaaagatgaaaaataacaatttaaacgatctaataaaccaaaatgatccacaaatagaaaagatattaacaaacccttcgtttgttccaaggttaaaattaaatgataaaaaattgcaaaattttttggtcaataaatttgatgaaatttacacttatatttttgaaacaaaagttataccaagatctgcatatgcttcgttttatttgataatgcagagtttaaagcaaaacataaaagaaaaaattttcaagaattccaaatttattgatttttataaaaattttcctaaaaatattaaaaactactctcctccgaagcaagacatctttttcgacattatccagttcgtcttaccaaatgataaaaacgattcaaatttattatttgataataaatccgaattttatatagaactactttcaaaatgtgatttagatactgtagctgattatttgatttctctgatagaagaacaagataaaaattttctttcgataattcacgatattaatttctttgacactatttgtaaaaatatcattggaagttccaaacttagcacaaattctcaaaagattttacaagtttgtcttagtaatggccttgaatccaacgtaatatcatccttaacaaaagataatttcatatgtaaatttatagattttgccacagacacatgtgatagacaatgtctttctctagtacaaaatttccatgccaaatcacattctaaaaatcacaaagtcgaatggaagaatgttcgactttctatttcaaggcgaaaatctaaatttgtttccattattttaaactcagaaaagtttaatgaatctgtgaattattctcttcttattttgtgtcggatgcttcgaactaataaaaaactttttaatggttttcctgcagttgtttctaaactttcaaatgattttttccatttcccaacaaattcatttttacataattccgttttaagcatgtttaaggtaatgaataaaaagatgttgttgacggatgaacttgttaaggaatttggaaatgcattaattaaagcattcgaaacaaaacaccaagaaaaaaataaatatatgtattggggacaagcgcgagaaattttttatataatttttccatatttaaaactgtttgatccagaaaaaattggattaattaaagaggaatttgatagagaagaaaaaataataaaagacaaaacgccaataaatattgtggaatttaagaaaaataagaaaacgaaaaggaaaaagaaaactgtttatataaagaaagtaaagaaaacgaaaaatgagaatttagaaaagaagagatcaatgatagagttattactattaatactacttctgataatttcattgatcgttttgttttttgctaatcatcttagattgcgaatcgaatgggtaaattactaaataaatgtaatgtttgttgttatataatttttatatttttatttgataaaagttaaaaacatattgtcatttgttgcaattatttttattgaacatgtaagaattaaaaaatataaaaagtaaattttcatcaaaaaactaaatcatttcatactatcaattttttgtttgaataaacgcaatagaaagaaaatagatgaacttacattacataattattaatactataaaattgcattaggaaaataatttttgtgtatttctttttttattgttattgtaatcaaaacaatatgaagaatttttgctggatcaaatacttaaaccataattaattattatttatcatagaattataaaaattatattttgaacttaaaataaaattaataacatatttataggcaacatttgaatgaaaagcattttcatgttaaactttcaattttttctcaataattaaaattcttgcttaaataaaaatctaaatcagacgaatgctacaattaagtttcataaaaaaaatcacaacattataatttatgcaaaaattaatagtggaatctctaaatagatttttactgcttatttttatgtttgccttctattattttatccaacagcattgcgtttgccttaatcacatcctttgccggcatcacacctaagtaagcagtgtacaattcgtatacttctactccgttatcatttagctttccctgtaaatactttatgaactttgtgtatgactctgtttcgccagaactgttgtacttacttaaaacgcttttatccaaaacaacgttttgaccttttgtgtttcgcacaacaatttcatatgtatattggaaatgtatttcattccgaagcgctgcaatgtaacgactttggaacgctttaagtccaaacgaaaccatatttcgctttatcttttcgcataagtaatattgcctggcttcaatatcgttgttcgatttcggtggatcaatgttctccggctcacgatatgtaccattactacggttgacgagaatgtaatgaactatgccagtcatataaatcgatggcttcggcttatgcttatctgatagatatcgattaagtttggcacaaaagtctttagatacggtatggatcttatgcgtaagctcaggtgttggtttctcttctttggtcacaaaaataagaacatatggacttttgccatattgtatcttggaaagaaaacatcgctcaacgttatggtcaaagtgaacattgccacccctgtgaacaatggagtcagctgtgggctcttctatgggcgcgttttcatcaaatgttgtcgttcgagtttccatacgttcaaaaagtgatatctggaaaacatcccctggttcgagtggtgatgctgagggattagtgtaacaagcaactatttgatgatcacgaaatacaataaattcaataattaattttccttgatcgctttgaattggttcaaataatggttggactggaatcttatcagttatgtctggaaagtttttataatacggagggagcattaataggaatttgtaatcttttacacaaagttcgaaaaataattcaatgtaacgagcatatagctcacgaaaagcagcgacaatgtttttggacatgaagttttcgaaatgagcgcccagaaggaaaatagctgtgtctttaattatcttgagaagaaaacctaaagcttcttcggaataattttcttctgaaacaatagaaaataaaatcccattccacatcttaagaacaaccaatttatcaccagcatgaaatgaatttacattttcgccaaaattttggaaaagaaaagcattggaattaataagtgtcaaaccttcttcatttcgtgtgttcaatgggtaatatgttgttgagtttgatattactttaactgagttttttggcgagaaattaaaatccatggattcctaattttttatatggatctatcggcatgtttccccctcaaaaacgatcgaaaagtattcaataatagtttagaaccttcattttaaaaactttacatatgatttttgtattccgacatgcatatcggttttgcaacgatcaaatttgattgaattatttttttttagaaatcataatttccttctttgtgtttgatttttagtgttgtatttgatttattttttttgcaaatttctaagtgcatgttcaacaaatttgtcgcacaaaaatttgtatatgtttaagcatctctcttaaaaataaatacaaataaattgataaacaatataatatggtttaaaggatactcaattttttttgtctgaaacttcaatgaactttacattattttttcaattgatttatcattactcaaatatttataaatacttcttaaatattttttcaaaaatgtttatttcactcaatcaataaaattggatattttccttttggatacaacatttcgcattcattgaggaagtatccccattcaagctcagatgtaatttgaattgtgtcattctcaaggtccataacgctgatctttttgaagtttggtgcaagtttgttaaaatattcaattgctgattcgtatgaaattccttttggtagtgatgtgaaaattgcatagtcgcgtgtataaggcgcaagtttaaattgaaaagtatcatcagatttttgaatttcttcgattaaattaagttttgtaaatccacttaattctgcatttttaagaataaggaaatttatcgaacctaaattactaccaaagtattccctgaaacaacaaataacatcacgatcatttcgtatccatattttgaagcgtgatttatcttcatatccaaagactgccgtttttccttctttttcagcaacctgtttgaacaactcttcgtagttacagttagatgaaatgtgacgttcatatcttgaaacgccaatatggaatttaatatcttgtcgaaaaacaacatcattttgcccacttttttgagatggagacaaagcatctagttgaacttgaagcttcttgcttttgctttcttcttcgttaattagtgaatcaacatatgaaaggatttcgttgttgttcattgatgaaacaatttgtattcaaataaccggcataccaaataaacggtcatcgcttaatgctaagtcacatcacattttcactatttaaaattttcatttaaaattaaatactttaatgcaaaagtattttttaatctttgggaactaaaacaaattagatctcaaagtctcaaattggtttaattttaataacataaatgaacttacaagtttaagcatttcataaaattatctaaattaaagcattcatttaaatcattttagagattcgacaacaaaattagcaaccgagcgcttaacatctgtttccatattgtttccttgttcggttcctctatagtagttccaaatttgtgtcaataatctgaaatgcaatattgctgaagcagcaagaaatatggtaacagcgacaccaaaaacgccagttccaatatttttgttggtgaacaggttaattgttgtgattaggccaacacttccactgctatctaatccaatagctaaaattgtctcaaagaggcatgttataccgacagataaaaatatcttaatgaaagaaaacgttcctgcatttgtactaagtgctttgtaaatagaaagtgcatccaaatcaattgctaatggaacaacaatgaataaataaagagatgaaagtgcaatttttgaacctggagaatcgacgccttccttgacactaagtaaagttagtgttccaatccaatttaatgcaaatgatattgccataacaatccatgaaaaaaatgcagaatgaaccatgccacgattagcaggttcaacttcttcgatatcaaagtgaacaattggatagcaatatggccaatttggagcaggatcattacttccggtttgacgtgcttgagtaatttcaagttcttgtttgttaagggagtgttctaaaagatttaactgttcctcatattgtgcaagttgttcttctgtaacttcatttgagtttattgtgcttgatatttttggagtagctattggacttggaggaacagggtttgtcacaggttttaaaggttcttcgttatcttcgaatggtgaataattatcgaggtattcgctcatgtcgattttgttttgtaaagtacataaaaagtggtactaccggtgattttcgttggacagttttcttccaatggaagaaacttaattaagataataatttatgagctttgctaacttctcattcccaaagtatttgtttattcaattttctgctatataaaaaaggtataatcaaaatttcaagcattaataaatttataattatttttcctagctatatctctgttacacaaatacttcagcaaagtcaagttttatatccaaacaaagtaatacggaagttcttgtatatatgaaataaaaacccaggaaaaccgttcttcaaacaatgtcactttttattataaagtaatagcatttgattaagtcactttgtgattaaagtattcaaaaatgggttcatgagaccgttaaataggagaacgttatttgtcacaaagcaaaaaaccgttttcaaatgcaagaagaaaaaaattttgcaccacttcctgaaatctttcctacaaacgacataccaatgttaggcactgaaactgaagaatatttaaacagaatgattttggaagaaatcgatgaaagaaataaaatccaaagagaaatgaaagaagatatctcaaagttttatagagcaactcaaactgatgtatgttttgaccctacacaaattgaatttatgattcaagcaaataatagaattgatgctcttcaaaaaagattagaaaaacttaataatgggcaaccattaagccatgaagaggtagaagaaacaaaagcgagggttaacgcatattcatccttcttttctgatcaaggagaatctctcttaaaatctatcgaattaatggaagctaaaacccaacaaatcattggaaagtcaatgccacatcttattgcttgctatgaaaaagaacttattattaatcacgacaatagaaagaaaatatcagatttaaatcaacaaaaataaaaatgttttgatacacttacctacactgcttggttgcttttggtgtttatccttgttttatttaatttaataaaaaaattattttgatagagatctcattcaaaaataaatttatcgttataacgtccacctacctaaggctacaacctttaaggtacacaaaatatttcatttttttaaactagtttaaatttacaaaaacaaatggagaaatttaatttaaaaaacatgtgtcatacataacaaaccaacactggaattggggtgcccgataatttcaatgttttactcacccaccaaatatgcaaaagtgacatgaatagcaaatcatacttcacaagttatgagaaccagaagcggtggcaggaaaccaaagaaaccagggaaggatgaatatgaagtagaaggtagtggtgaagaaaatgaacctatagataatggggtggtagaaggtgccaatgatttaatgtctcttccgattgaagttcttcaaaaagagttgataaagagaaagttctttccaccagtaatttataaactcgaaaagtgggaactttctaacttaattcatgaaatttcaactccttttaacgaagatatgtatgttatgggtttttatccacctttacgtcaaacaaaacctttgataacagatgatgttgataatgaaaatgatgattctaattccggttggaataatagttattattattataagacaactaatatcaaatatccacgaacagttatatccgaaccaattacatctatacaatacaactggggtcaacctaaccaagaaatcacagctgcagcagtcgctgaaaaagcagaagtatatgaaacacttcctattgaatataacacacagctcctcaaccacggtgttctccagaaatctattgatcttttgtcaaaagatgagattcaaacaatcgttgaagactttaagaagaaaactgacatcgataaaataatttcggattatggtttggaaacaaatgagagcatatttgttgaagactcacagttcaaagaaacccaagattctgatgattccagtgatagctcatctagcgatagttcttctagtgatagctcatcttcaagtgattcaagcaactccgatgattcagaaaatgaggatgatgatcatagggatgcacagctataataaagctagtactacaatgttttgttgttttcttgaaccacactaaacggctatgttgttcacaaacgttcttttgtaactttttgtggtgatttttcggttttcattttgcacaacaagtatcctactgcgtgcaaaaacgtttcactcgtaaagaaggataaaaaacacaaataccttttgaatttatagtcaatgttcttttgatttaagcaaagaaaatttattataaacagtaaaatctagatttgttttatgtgaaaaatgtattaaacatcaaaattatgaatattttattttttcattaggaaaatgaaaattaaggaattaacattatcatattatgaaataaactgttaggaaatatttttcatttttttctgcaattttaaaaaattagcagctcataaaatatattttagaacaaaaagaaagccataaatttatgccaaaggaattttatttgatcacatggaaaatggcaagaaaactgtgcgcccattaaacaaaaagccatagaggaagctattgaatccttcactaaaaatatgaatttgttttcatcttgaaaactcaaacctgtctcttggctaaatattttcgtatcatgataaaaattttcaaagcttttcttttgtttgaggaaaattctgttaattttttgtaaaacaatgaaaatttgtttcaatacactgaaaaaatgttttgttcgaactcccagtttttgatagatttacaaatttccccagatggttcattgggtaaactttcccatatctttttttggaattaaatttacttctgttggcctcgcaaattttgtcaggattgctctttacttagccttgttacttatatttgaattatatttttatttaaataggattacggaagttgcaattattagtttagccgtagttcttgcagtaattttctttttatcaaaaatcgcaggtcatgttatcaattctttattatcttctgtaacaacaattactaatacaaacgaaccaaatcagagcgatattcccgaaggattttcagaagaagtatggagtgtcagagacttactaaaaaacccatcaccaaatcttgatgtagttgttaatgatttaattcaaaatggttatgattgtgatgaaatttttaatcttgttgattacttaaaagacaatcaagtttctcctgttgtgatagagactgtaaccgaagatatggtttatttttgcggcaaacttcatccaattggaaatttatttgaaaggtcattcattgaaaattttattcctttgaataacacagttggctatactgttttcacactcatcgtcacatttgcatgtgtatatctttctttatatgtccgagatcaatttctagatcgtgaaaaatggtgggtggcctttgtagttagttctagtgtttatacgatattttatcctccgtcacatgatccttttcttatgaatattaatgattgttggggtggaggagctcgtgcattagccatatccataatctgtggactttggattgcattcttaaaacttcaagaaaactacggtatcagcactttaccattttatgacatgacaattaattggaatactattactccaatcgtttcaattgtctttaaatgggcaatgattctatttcaattttgggttttagcgccaatggtggggcaccccatttcggttattgtatcgttcattgaaagtgtctgtcgttatgcgtttggtcaaaatggtgttggaagtataatacatatgattattcaattagtacgtggatgtataagtgtagcatgtgtatggggagtgttacaagatagtcttgatgatttacatattgcagcatctatagcgatagcaacatttttaagtttaataccaattcctgataaggggcttaagaaaatctggcaaaaagtagtcttcggaccatttatatcagcagcaatatcattattgatatcatatattattacacattttgcaaaaccaaaatattctgttgttaaatgggtttgttttggtattttagctgctagcgacatagtatttccatttttagactcatgtcaacgatattttatctttcattgtatctttttccgctatattaaaatctttggatttattcgtggattaattacacaatttattgtcccgatatttatctcatgtacattagttaatacgaaactcgatccgatttatatttcatttttaatagtacatgcagtttataaatcatatacagaaccacatatcatagtaatagctattttcttatctattgtcacgttttattatgattttgatttgactgatcattcaacgaatttctttttatcattaatcattgcaacgaaacttgaatcattttatcatagtgtcgaaaatgtatataagagtcgttatatagttatgttattttcagaagtaattgttgattacacacaaaatatattaacagcactatttcttgttattggtaaactcattgatatattcccattaattgatttttgttggaaagttccaacattaatttgggcatttataacagggggtaacacaggtaaatatttaggaattggatatttcttaacaccacatccaatacggccatattatttttatgatcatccaaaaactactgaaccgaacattaatgaattatttaccacgaaaatcattgatcatccaattgaaacgccagtatatttctcaatgtcacatggattaacagaatcatttgctaaatatgtacggaatggtcgattaggttatgttaatgttggtgacatgtttatattcatatcgaataattttatttctattgtacatgttatctctatcgaaccaaattgtattaaaatccaaatgagaggtttagaatattcagcacaaactgcatgtcatgaatcagagattaacttcttaaaacgaatcattgatgattatgaagtattacctaatttccatgcagcttttgtagattctgttttccaatttgatttaagacttttaagttttaatatatctatgtatgaaacgacaaaaactgatttaagtacttctttctcaggtattgatcaagaacaaatgcgaatgggatttttaaattgtttatgttatatattaactaaagtacatattgatataaatgaaatacaagaaatccctcaaagtttagaccatgaaactcgagcatattttgcatatgataataaaatgcgccaatttttggagcaatcacaattcgaatttgatgacaattcattacacaaatatttaatcttgttctatatcattggtaaacttgtctataatcaagacggatcattaaacaaaatcagtcttacaaatgtatttaaaggagatgttgtcttacatgaacaattctcttgggtctttaattcggacaaaatattaaataatgttatactacgtgcaatatatttaggagttggcgtaaattatatgaactcaaatggcttaggttatagttcgacagatccacatgatgaaattgttgcgttcttgaatgaattcttacaaagttatgttgtcgtgcctataaattcggaagaattccaaaaggcatttttggaaaaagaaagaacaattttaacagtggcaaaacaacagaataatgaaccaattttgttgcgctttaatgtatctgataaactcgaatggtctgtgtacaaaattaattccgaacatgtaagaagtttatgggcatatgaagaacatgacttaatgtatcatatgaattcggagtcggaaagaacttcaatacaatcgaatcaaggcgcattgaataatttggtgattcaatcttgtgatttgccagtgggatatcctgcgtatgtaagtccgattttgaattcttattcaacatgtttcgatcttttttaaataaataattatttcgtttaaaatattttatttatttatttatttatggatatgtttgttttgtgtgataatacaatagagtatgagaaatattataataattgcaattgctagaaatatataaattaagattttgaagataattttcgttgatggagaacttgaagtagtagttgcattctttgtttgccattttttaagatgaataatagcaaaaaatagaagaatattcaattgggtaaatatttttttttataaaatagtttcttttctttggttttttaatataaaaactttgttaatcttattttcgatatgaaaataaaaaggaactgatgaattggggtggtctgatttttcacaaaaatttttgaaaaatactttttgaatgcataaacttttcaaatttgaatatgtcagaacagaataaattgtacacttttgtgtatccacacaaaaatttgacaagagttcgtttggatataaattaggcaaaatgtcgaaacagacagcatttcgccttgaagattttattgttgaatccccaataggccaaggcgcatacggtcaaatttataaagctgttgaagttggaactggaaaagtttatgcattaaaagcaatgaatagaagatgtcttatgaagatgaaaaaacaaagcctaccaattgtagaaaaaaatgcactaattaagtgtgctagtacttttgttgttcgtttatatggaacgttcaaggatgattcaaatttgtattttgtacttgaattagcagaacatggtgaccttgcagaagccgtaggggatattggaagtcttaacactaatgtagttaaacttctttctgctcaaatttttgaagcaatctgtgtatgtcataaagcaaatgttatccatcgtgacctcaagccagaaaacattctcctcgactcgcaaaaccacgttcttctctcagattttggtacagccctaattgaaaaatctgatagtcaagaattaaatcgttcatccattgttgaactccagcctttgttgccccagagctccttaatgatggaaaaatctgttatagttctgatatgtggtcatttggttgtgtcatattcaatcttcttacaggcacagcaccttttagtggacaaaacacagttgaattaatgaacaacatcactgagcttaagtttaatccagtcattaaaacacttccgaaaaccgccaaagatctcatcacatccttacttaagcttgatccacacgagcgtattggatacggggaagccaaagaaggctatccctccattcgtaaccatgcctttttcaaaggcattgattggaataatttgtcaaatatcaaaatgcctgttttcaccaaattcgaagaagaacaacaaccaaccattgcagattccatgctaaatgaaggggagaccattctaatgaatagtattgtcgacagaaagcgattatttggttggaaagagcgttcgatatttttgactaatcaaaagagacttttgttatttaacaacaaaacgcacgagtttaagatggcaatagcattaacgaatggagtcaaagtgaatgttgcacaagatgggaaagaatggacaatcacttggggaaaaggccaaacgcaaacatttagatcaaatgatggaactggcggaatgtgggcagcatcaataatgagggaatcaatcaaaccataaaaatcttattaaaaatttatacataaatgaaattaaattcactttttttatgaaatattcatttatcagattctttaaaatatatttttttggtttcataatatacaaattaataaaattttacattcgaaaagaaattacatagttagattcatattatgaagttctttataaatttgtataatgaataaagaaattaataataaaaaaaaaatgttccaatatatattgaaactgcaaaaaaaaggtattttgaatactaaatcgtttgtgaaaaattaagtaaaatatcatttaatgtttaaatatagatattataaatactagtagtgaataaaagaattataaattataaaaatttacacaactttttccttacaaatcttagctttagatgattattaaattgacttagcattagatttttcttcaagtaattcaactacatcactaaaaccatatttagatgccaacataagtaatgtattaaataatttgaataatttccaaataaaattgtttaatttcaaattactaaaacaaacattaaaatatataaagaaatatcctcaacagtgatgtcgattccttcttgatcaagaagtaatttaactgtatctattttaccactaataattgctaatgttaatgctgtttgaaataaattaaataatttccaaatcatatttttgaacatcaaattttttatatgaactgcaaataaaacaattaaatatctttagcattaatatcaatttctccatgtccaagaagtattttaacagtttcagtattagaatagcatgcagcacccataagcggagaaaaaagtcatgcacaaaaacaccaaatattatattggaatatgttattattagaaaaaaatttaaataatttaaaaaaatattttgacttataataattcctttttgttcaagaagtaatttcaaaattgtattatgaccttgttcacatgcaactaaaagtggagttataaaaacttaaaacaagttccaacttttggaatgaatcatcaatttgctataataagcatcattataaagtaatatatatcttgtgaattaatatcaataccattttgatcaagaagtaatttaaccatttcataatcattattttgtacagatataataagtgctgcccaaaataagttaaataaatgccaaatttaattattaaacatgatattctttcaaaaaaacattttacgatacaaaaaaatatctttagcattgatatcaatatctttttgttcaagaagtaatttaacaatatcaatattacgactatcaactgcattcataaatgctgttccaaataatttcgtaaaattccaaaagtaaaaaatatacaaaaaattattaaaacaagtgttcaataatgtaaatcaatatctcttctattaatatcaattcccccttgtttaagaagaaattgaacaagctcaaagttatttgatcttacagatttgaaaaatattttatttatatctttaatattatgaaggaagcacataataaaaaataaatttccatcagttgttgcttcactgattatttcatcattaatttctaatccttcatcttgtaaatataaaaaaatatcataattatgatataaaatacatttaattccgagatattctaagttaatattttcaacaattttattctcatataaatatttaaagatatcatttcgatgaaatttaattgctgcttcatatgcaccttcaaatgatgaatgattttgtttacataaaagaattatctctgtatttccacctacaacagcatatttacttgtttcatttacattggaaccattcataagtaaatatttaaaacatttaaccgaaccaaaaaatgctgcataatcaattaatgtaacattataaccattaataaaatcatatcgctcataaattgatggttcaatgtattgattaaaatcaaaatcattttgtgatgttatttcttgaagtttttctacttcatcatttcgaattatttttaagatttcattcggattatgtccttcatgaacaagtttcttatgaagtgcaaaatcattatttgaaagttcttcaatgggaaaaggaaatttgatgtttcttaaatgaacataattttctatatcatcatttaaactaattaaatgcataaaatatggattatttgtatcatcataatgtttatgttttttaacaagttcagcagaaattaaattctcttcaagtaaatgagcaataatgtagtgagaatcatttgtacaataattaacaattatttcatataaaatttgaaaaatttgtggattttgtgtgaaaatttgttcttcaatggtttctaataatttaaggaattgaatatatttattaattccctttccatgtgaaataaaagaagaatatacaaatttacaaagcaaagaattgaaggaataaggaaaatttttatcaaaatatttgattattgtttgaactactgaatttaaattttctagttttgcttcgtaaatatattgatagattttttgaagttgtttaatttccaaatttttattttgactcataaaaaaattaacacttttcattcaatcattcaaaaaaatcgaagcttaaataaattttaatgaaaaccaaaaaattcaacataagtgatatgtgaactattctgtgttaatgaaaacaatcacgtgaagcattttatattaggataaatttagaaagtatttttgaatattgtcaaattgcaaaccccaggaattttgatcattctcaaaatataattgaaggccttgacatctctctgttacaaattttcggtcattctttccaaatattttctattgggaaaattccaagttaggttgaaaagtaagaacataattttttacaagtgaggcaaatttaaacaacgtggaatatctcttattgaaatatctaacatctactgtgttcccgtttgaaattcctatttcaattaagtattcatatgtattgattgattcattaaaacgaaatccttcaactgaaacatacaatggcggataagaagttgaagaaagaagaagcgaaaccttgtattgtggaagagaatttattggaactatcatgaaatgaagtgatggaggtagaagaactccttctttcaaaataccactttttaaatacatcattttgacaaaattcagaactaaaacttcaaaccttccaaacaacaaatgggctaattttaaaaaaatttttttgaaattaattaaaaaaacaataaaatccagaatagtgttaaaagtgaaagtaattaaattttctattttcattgaacagtgaaatattaatattattgcaattttgcaaaattttattacactaggaaacaaagtgtaaaagtaaaaatatttaaaaaaagaattgttctcaagcaaaaattttttatttgtcaaattgtagttttgatcaaaatttactggcaaagtcattttccatttaaaaatgatttgtttgtgctcacaaaaattgaattcaaaattggcctgcagttcaatggatccgaccacttgaatgtctattaaggttccagctggataccaatataaaacttcccttgaaattgtggcaaagtacattggttttaatgcagattttaatgaagatacagaaattacaattccaacacttaaggttggagaaaaagaaatttgcggatttgtttcaattgcaaatgaaatggctcgtactacgaaggttggagggaagcttgtgagcaagcgtttacttgcagatggcgatgctcaaaattcagctttgattgaacaattcacatcaattgccgattcaatatttaacgaaacaagtaaatcagatgtaaaggctgttattggtcaaatccagtcacacattaagacaatgacttatttggtttctgatacattaacaatggctgatattctcatgtttttggctctttacccatctgccaaagatctttctgatcaggaaaagaaatcagattttgccgatgttgttcgttggatgctctttattaattcccaacttggaaatccattccaaccaattgaagttcaaaagggagaataccattccaagaacaagggtacaaaagcctctcaacaaaaaggcaacaatcaatctcacaaaaataataacaatgaccaacaattaccacaaggcggcaggaaagccaagaagcaagctaagcccaagcagccagcagctcctaaagaaccagaatgtgatccattccaaatgattgatgttcgtgtttcacgaattgtaaaaatttggccacatcccgatgccgatactctctactgcgaagaaattgatattggtgatggtgttatcaagagggttattacaggtgttcgtaattacattccaattgaggaaatggaaaatcgccttgttgttgtcttcactaacatcaaacctggaaagataagaggccagccgtcagaggctatggttttcgccggctcgaacgctgaccattcgaaagtggaacttttgacacctcccgccgatacaccggttggaactcgcgttctctgcggagacttcgtaaatcctgaaattaagccatcagttgatagcaaaggaaagtggtggaaagctgtgagcgcaaacaatcaattgacaatcaatgctgatggacaagcatgttacaaaggagtaccgcttcgtgtcccacaaggtaacattacagtcgccacccttaccaactgtgaattccattaaataaaacaaaaatacaaaatttgattaatgatatcattaattccaagaaaaaaaaaataataaataaatttctttaaataaactgaatgaacgacatatgttaattgcaaactaaagtatttctattgataaaagatgagaataagttgaatgcttgagaaagaccaaacgcgcctgcaaaaaacgatataactttttgaatatcaaagattttgatgaaaagaaaaagttattataacaagtgatttataaatcataagtttgttaaacaagtgtatctatgaaacaagcattttccatggtgaatccctgaagcatttcttgcgtttcagcacttattagttcagggttttcatacgaaaacacaggattttcatttgtgaactgcttatcaaattgggaagtatcagtatcactacataaattaggcttccactccataggcactgtctttaacaataagccttcccaatcaacgccttcaaagaatggatgattttgcacatcatcgatttcatttggaccagatccaagtctttttgcaggatctttttccaacaattttgatatgaaatcaattacttcatttgatcctccaacaggaaactcgacagggtcataaactattgagcgaaacataacatttgtatcagaattataaaatggcgaacgaccataaagcatttcatatgttaaaatgccgagcgaccaccaatctacagctttatcatatggtttcgacaagagcatttcgggagcaacataatctggcgtaccgcaaaacgttgatgctctgtcaccttcattatccattttttctttagcgagaccgaaatcggtcagtttaatatatccatcttcgtcgactaatatgttttcaagtttaagatcgcgatgtacaattccaatagagtgaagataacaaagcgcgagaactaactgtgcaacatataactttacacgatcttctgaaaacttcctttctttacatagacgagtaaataattctccgccaggaacatactctaatgctaagaataattttgttggtgattgaaatgaataacgagctgatgtcagaaatggatgattagctttgagtaatgcgtttctttctgttaaggtcttcccgatgagattataatcggctaagaaccttttggataatgattttaatgcatataattgaccatcacttttatgtttaactaattgaactttaccatatgaaccacgcccaatgacttttagaacagtaaagtcagtgatttggatggtgactttctttctaccttgtttagcttgcgctaattctttcatccattcttgagtttctttctcggacttgaattgaagataaagtttctttttatcagtacgaataaagacaacattttttcgtttgttctttaaatcaagcgtaatttcttcagcttctttcatattgattgtcttgaagcttttctgccctggttttttactgtagtttaaaacatttccatcaagtacaaaccatcgcttttgccatgtcttgaagatgccgccgggcttgtatgcaaagccttgcttcgataagcattcttggttcgccattaaatcagaatgatttttaacaacatgttgttttctattcaaaaaataaattcttatcaaaaattagataaaggtttgaattaagtaattggtccagattttatttctcaatggagatatcctttgaggtttttcaaagtttctaattatgaccaaccccaactcaaatttttcatcaacgtttcgtcagcgtcattttttggaaaaatccatcagaaaaaaacatcaatttcaaaccggcagaaacttaaaatttgttaaaaacaaactgacaacgaggggaaatttgaattgttgtataacacttttcattaccgatttctgaggtaaaatcctcagaatattttaacgctgaccgatcatttcacacacaatatttcctttaggtttgttttgaattaaaagtgttatttcattccaacaaattgcaatttattttttctgatagtgctatcgaatttgtggaaaaaatcaagtcaaattcaaatttaaaaaattcctatgtaaaaatgattcataattttatctcttcattaaatgcattttcaatgaaaattgtgtgaaaaatattttataagaattcgattttaagattatatccatcaacaattttgaatgagttaaatttgttcagtgcatcggctgcttgtgtttcatcattataatacacatgagcaaagccatccatcatctcggtcttttggaacccaggagtttgtctgaaaatgacggataaaagacgagaatcagcctttggtggatatcctgtgaccttaagaattctatttgtttcctttgtttctggttcaggctctggttgttgttcctctgtctcacctcttggctggtaaaattctgcaattactttagaattatttttggcgtattcaatatgaagatcttttccaagcaaattaaatccttgaagtcgctgcatgacaacattagcaatttcaacactagaaaaagaaacccatgcttggcctcttgtttttgatccttttcgagcctcaatttcaacaacgggggcaactgaagagaaaaggcaatatatttccctcttaagctctggaattgaaattttgtcattcaagttgttgagatagagagtttggctaggagcaattgggagagacatccaaccaaatttgggatacccctattttaatcgatctttttctctttgttttttttgcaatactgacacataatacagtattattgaataataatctttcttataaagaatgatatgaaagagaacaaatggccctgcaatcttgtgtcattttagatgatttgattttccaaagttttgagttttttaaatttccttatgaaatcaaattcacatgtaagcaacacgaaaaaaaaggagagctaccaaaaaggccatttaacgttaggtttaaaaagaaatgaaaattgatcaaattaaaatttattgtttaaaaacctgcacgaagggcaagaaccatatggagaacttcgcctgcattgatatgtgatgattcaatagttgcttgatcgttcaaattttgaccacggaataaaagtctttgttgttgaacggaaataccttcgcgttgttgaagctcctcttttattgcagcaattgtcattcctggttcaacatcaatttggtgctttcttccagatacagtgtgaacttggatgagcattttgaaaagtggtattgtttattgcctttgacatgtgatttgaaaatgttgattcaccattgaatcaaatcacattagatattattatttttatacaaaattgttggtactttggccgagtggtctaaggcgttggatttaagccccaataccgagaggtgcgtgggttcgaaccccacaggtaccaatttttattttttcttaataaaatgaactttttttacgaatcatcaacttggattttgttatttggagttgaaagtcatggcaaacaatggttgtggattgttagatagatgatacaaaattgtcaacataaagttctgttaattaagtggttatgacggttttttattcaaatgcttaaattgaaagaaaaaaataaaaacttctcgaaatatattgaatattttcatcaataattggcttaaatatattatactgtatataatttatatcattttagaatttaaaatgctattttctatcacataatttgtttaattgaaaattaaaaaattaattaattgatgtcattttgtatttggtttttataagtttgcttcattttatccaaacattgttcgtatcttaattcaaattctttttgtataaatttttgtaaaagatttgaaaactgttgaattatttcgtttcgggtttcgtttaatgaaatgttacaaaacatttccaattttttaaatatgacttcgatatattcatcgaaaacattttcattttctaaatccattaaatttacttcatttttacaatcaaaaattttattttgtgaaatactttgaacaaaatcacaaaaatttatttttatttcgttttcattttttatttcttcaaatgttttaacaattatttccttaataacattaaaagaattaaataaatcattttttattttactaaacaaagaaatcaaatttatttcattttgtataatttgcttttgtattaattttaaatgtttaatttcaaattttggatttatattatcaattgattaataattcaccatcaaattttttctgaaattttgcaaaaaaaaaaaaaaaattgtttgtttatccatctccatttttgtgctttttctaggagatattgattcttctgtgtagttataattccagacttctttaaattaatcataattttcaacttttttacaaactaattagttgaatgtcatggaacttattccaccaatacatgtcgaaattgtggcgataaatctaaacacgaagattacctcgaagagctcaagacaggcaaagttgtttattgcaaaaaatgtgggataggggttgttaaacctgattccgtattatttggtgaatcacttccaaagcgatttttatcatctttatccaaatgactttgcatctgcggaccttcttattgttattggtacgtcactgaaagttactccatgctcattacttccctggatattgtcgaaaagattgtcttcgagttttgattaataaagaacctgttgcgacatatgaagaaaaagtcagcgtcgacgaaagacgaaatgttttggtcgatttagctgagaatagtcataaagaactgtttaagttcggtcatgttacaaatcgaagagatattttccttcagggcgattgcgaagaaatatgcaaacaaataattgatgctttaggatggactgacgaatttaatgaaattcatttgtaaataatttaattgattatcaaaaagtgtaataaaaagacttcattttcattattgattgatgatacaaatttcctataaaacatatttttcaaaattttttatttaatgattattttctttttcttcaaatctaaattatcctcgtgtgattggaacaaatctaattagattgcccactttgtcatcactttattgggatcgcgctttatggcaatttcttttaattagcccctttttcatttagtaatttaactatttctgtatgaccatttgaagatgcacaaataagtgctgtatcaaataatttaaataatttccaaatattattttgaaatataaaattattaaaataaattttaaataaaacaaataaatatccctggcattaatatcaattccttcttgttcaagaagtaatttaactatttctgtatgaccatttctagatgcaatcataagtgctgtaaaaaataatttatataatttccaaatattattttgaaatatcaaattattaaaataaattttaaataaaacaaataaatagatttagcattaatatcaattccttcttgttcaagaagtaatttaactatttctgtataacctttccaagatgctaaaataagtgctgtccaaaataatttaaataatttccaaatattattttgaaatatcaaattattaaaataaattttaaataaaacaaataaatatctttaacattaatatcaattccttcttgttcaagaagtaatttaatttctaattgaccatttaaatatgctttcataagtgctgtttcaaataatttcaataattatcaaatattattttgaaatatcaaattattaaaataaattttaaataaaacaaataaatatctttagcattaatatcaattcctttttgttcaagaagtaatttaactatttctgtatgactattccaagatgcaaaaataagtgctgaactatttaatttaaataatttccaaatattattttaaaatcgaaaattattaaaatgaatttcaaataaaataaaaaaatatttttagcattaatatcatttccttcttgttcaagaagtaatttaactatttctgtataaccattaaaagatgctaacataagtgctgtatcaaataatttcaataatttccaaatattattttgaaatattaaattattaaaataaatatctttagcattaatatcaattccttcttgatctaaaatgtattttacaagttcaatatttcctgatttagatgaataacctaaaatatcttttggagtgtgatgctctttcataaaatattttgtgagatatatatttccaattcttgcagctgcattaataatatcatcgttaatttccattccttctttttgcaaatatgtaaagagttcatagttgttccatttgatacatttctttcctaaaaattccaaatttttgatatcttctaatttgttttcataaagatatttaaagatatcattacaatgaaatttaattgctgtttcatatgcatttttaaatgatgaatgattttgttcacataaatgaataatttcaatgtttccacctgcaattgcatatttacctgtgttttccacttttgcaccattcataagtaaatatttaaaacatttaattgaagaaaaaaatgctgcatattcaattaatgtaatccgatattgattaataaaatcacatctttcataaactgatggttcaattatttgattaaaatcaaaatttttgttatttcatttggattatgtccttcttcaatatatttcttatgaagttcccaatcattctttgaaagttcttcataatgtttttttatatactgtttaattccatagcaataatattcattaatttcttcttgcgtcatgtgatgtgcaagacattcattggttcttttataatcaacctttggactctgaagaaatttattttcaaaaagataataaagaatatactttgattcttctgaatatttagaaagaagtacaccttcaaatacatcaaaaatttttgaattaattttgttgttttcttcaaatatttcaatttgttttaaaaattttgaataaatatcaaagtcattcattctaaacatggaaattgtgtatattgtttgggctaatataaaattgaatgaaataggatgattttcatcaaaaatgtcaattattgaatttgctgattctataatatttgttttagccaacctaaagagggtttgcatgattgattgatgaatttcgatatcatttaatagtttttgcttctttattttatttatggtccgtctttactaacggtatgtatcggctttttcattgtttttaacggtttgagtagattttgaagcagttcaagcatcacatcacatcacacaacattctgaaatcctatatataaactatttaataaaaaaagatttgccaaacaaaattttatgactgatttttctaaaattaaagagaacttatcccaaattgaagaacaagcaaaagaaaatccacaaatatatattgagcttggtaatttattcttaagaggagaaggtattgaacatgatatcaataaagcgattgaatatttccaaaaagggtctgatgcaggaataaatgatgcatcatttaatcttgcacaaatttatcatatcggtttgggaggtaatccaattgatatcccaaaaagccgtcaacttatatgagaaatgtgtcttaaatgacgatcttacagctatgtttaatttagcgatgatttatattgtaggtaatggggttccaaaaaatattccacgtggtattgagttactcgaaacatcagcacaaaagggttttgttcattctatatataatcttgcattacaatatttaagtggagaaaatgttccctatgattgtcaaaaagcaattgaattattagaaacaggatcagaaaaagggtattttaattgcacaataagacttgcgatgctttatcgcgatggttacaaagagattccaccagatttagggaaatgtggaagaattttagttgaatcagccaaaactaagaatcctgatgcattatgttcattaggagaatattatgaatatattgggaagaacacgagtcttattcaaaggtctgttgaatgttatgaagaagcaatcttaaaaaatcatacacgttcaatgtataacttagcaaatttactagttaatacaccaggacatttttgtgccacgtaatccgaaaagatcaatcgaacttttaacgaaagcttctgaattaggtgatttaaattcgatgaaaaaattagctgaaatttatagggaaaaaaagatccttataaatcattatattattatgaaaaaaaggttctgaattaggtgatgatgattgtacttataacttagctttaatgtatcaaaaaggtgaaggaatacctaaaaaaataaaaaaagaaatctttagaattatatcaaaaaaagcagcaagtaataaccatgttcaagcattaactaatttaggtgttatgtatcattatggaaaaggagtcgaaaaaggatttaaataaagcatccgagtattatgaagctgctgctaaaaaggacatttaaatgcaatttataatttaggtgtactttattcacaagatgaagaaatggaaaaatattccgaaagctttagaatatttcgaaatggcaagaaagaaaggggacacaatggcaatgcataacatggcattaatatatttaaatggtaatggaatagaacaaaatgtacaaaaagctgtcgatatatgtgaagaattaattaaaatgaattactataaagttattgatactttaattaaaatttatgcaaatgggaaaggaaatgttgaaaaaaaaaaaaaaagagctttggagttatgtcaatttatgttcgataaccaaaaatttccaatttttttagatgtcgctataaaattgttaaaagaagaaaaacccaccaaataatgaacgaatttttggaaatttttggaaaatggcgcaaagcagagtgatcgaatcgctttgatagaattaataagagtgtattcagaaggcgattttggagtggcaccttccgaagaaaagatgaatttctatcaggaaaaaaacttaatatgacccctgaatgcacgatttggtaaataaaatttctgattttttgttgaatatgttttagtgacgaaatatacacttgcatatgtaagtaagttttaataaaagatcaattttttcttctttcttagcatctgtaaaaaattactttgaatatggatgaaaataacacacttggagttcatgacaaaataaatattcactaacattttccttgatataaaattgcttagtgaatttaaaatattgacagtatttcaaaatgagatttaaaaattattttgttttaaaacatttattcttgatattcatattggatattatgataaaaaaaaatacttttgataagaattttttgcaacaaagcataataggactcatgttttacaaatccttggaatttgtgttcattgcttaacataagcctactatcaatttttttgataaagtttgtttgacatgaaaagtgatttcttcagatattttcaaagttttttttcgaaatgagtattacattttcacctactgaaagcgctatttttctttcatattttgttattatttttatacttattttagtaattatcatttgttgcattgcatttactattttgtctggaatacattggagtaaaattagatatgattactcaatagattctgaaaacattagttacaacttgtatattttatatgttatgactactatttcatgggtgtcaccaattgttcttgccttttttattataattttcttgattattccaatcaaaatccgtcaaaaaatccctggtaggatataccacatttatttatttatattatttttaattctattattcaatttatcatcagatatatgctgttttgcttattcagcaccaaataagtgttcaagcatcagaaatatccaaacacaagcattgcgatttgataaagaaacatgtaataaatatcactcaagcatcgaagcgttcttttatttatatgtcatttcatttgtactggatgtaattcttattttgataaattaacttttaatatgttgctatgtaaaccatcgcttattgtatttacttttttttatgagtgacatttttttgtcgtaatattatttattttgttataaatcttgtaactcctcaataaaagttttattatttattaaagatctattattgttataatacttacatttttgagattttatatttaaaaattattttgaaaatttatgttttttttttaggctccgctttaaagatacaagtatcaggttggggagcaccttatttacatatgatgtgtaggtttaagactttcagtagttgtattattaattctagaatggaaagaaataattgcatttgctctattagctttacattgttatattatatattccacacaaagaatgaaaaaaaaaataattaaattaatgctttataatgtctataaaaaattttgcttttacactcaagaaatttttttaattaaatattaccataaataaatgatagcttgtaaacgtaataatctcagcctatttccctttacatttcatagccctttgataaaatctatttatatgagatgatgtgtggcaaattgatttgagggggagttaaaactgacattgtttcatgttggagaaaaaaagagtaacttacaagaaaaacaatcaaaaaccaggaacaaaaagaaatgaaaatcattaaatcaattcaacaaatcatatttggtttaaataaagaaaatatttctcaagcagctcaatcaattatttccatatttgattatagttatccatattcatttaatattgttatgagtcattatgttattatctgtatttttattgaaaagaatgattttcgatatatatttgaattttatgaaagaaatgaaaaatttcaagaaaccaataaagtcaaatctaaaatttttgatgtttttactaatttccttctttttgcaaaatttattgacctcgatccaaattacacaggaatttacaagcaaaaattatattatccacttttgaaaatgtatgaaaataatattcttgatctaaaaatattgaaagatgagaaaaatccatattttatccattatatgtctaaagaagaaatttataaacaaaaaaattttagctcttttaaccaaatcattgctaattatgaagaattatcaaagaatgattgggaacttcataagaaattaatcaaagaaggacataatccaaatgaaattgcaaaaataattcgaaatgatgaaatagaaaaacttcaagaaataacatcacaaccaaaatttgattttaatcaaataattgaaccatcagtttatgaaagatgttcatttattaatgaagaaaatgtttcattaattgattatgcagcatttttttcttcaattaaatgttttaaacatttacttatgaatggtgcaaatgtagaaaacacaggtaaatatgcaattgcaggtggaaacattgaaattattcatttatgtgaacaaaatcattcatcatttaaaaatgcatatgaaacagcaattaaatttcatcgaaatgatatttttaattatctttatgaaaataaaattatcgaaattgatgatatagaaaaattaggctctctatgtattatgttttggaacattgaagtttttatgtttttacagaaaaaaatggaatgaaaataaatgaaaatattctcaataatatggtaaaaattggaaatctttatctcattaagtattttctgaaagaaaatccaattccaaaaaatatttttgcatactctcccgaattagggaacattgaactcgtagaatatcttttaaatcaagaaggaattgatattaatgttaaagatatttatttattttgtttgatattaatttcaataatttgataatttaaaataatatctggaaattatgtaaattaatttatacagcacttatttgtgcatctgaatttggttacgccgaaatagttaaattacttcttgaacaagaaggaaatgatattaatgctaaaaatatttttttattttatttgaaatttattttaataattttcgattttaaaataatatttggaaattatttaaattaaatagttcagcacttatttttgcatcttggaatagtcatacagaaatagttaaattacttcttgaacaaaaaggaattgatattaatgctaaaaatatttatttgttttatttaatatttattttaataattttatatttacaaataatatttggaaattatttaaattatttagaacagcacttatttatgcatcttataatggtcgtacagaaatagttaagttacttcttgaacaaaaaggaattgatattaatgctcaggatatttatttgttttatttaatatttattttaataatttaatatttcaaaataatatttggaaattatataaattatttagaacagcacttatttgtgcatcttcaaatggtcatacagaaatagttaaattacttcttgaacaagaaggaattgatattaatgctaaatctatttatttgttttatttaatatttattttaataatttgatatttcaaaataatatttggaaattatataaattatttgatacagcacttatttgtgcatcttcaaatggtcatacagaaatagttaaattactaaatgaaaaaggggctaattaaaagaaattgccataaaacgcgatcccaataaagtgacgacaaaagtggttttgatgaataaaaatttgtgataagaagagaaacataatgtaatcgaagagatacagaggtagaatgcgctataacaatagtaataccaatggcagccccaatttcgggaccaagtgtacgtgataataaataataacatccgccttctttcatttctccattagtggcaataacacaaatacttgtaagtgttccaatggaaacacatgtggtaataaaataaaaaagaagactatagccccaaccaatgtttgaaatcgtacgatgtaaatcaaggaaatatgtaacacatagaagattataaaatacaggaataaagacaccagaaaaccagtggaaagtatgttttatattaatgtgatctgttaaatacagaaatttccatcatttatattaatatttatttaagtcacattatttttaatcttcattggagtctttttcttcacctttttttctattcattataaaaagggcaagaaaagttattccatcaattaccacagcagcaattacaattacagcaattgcccaaggaggtgcatctgtataaacgacgacagtactactcattggttcaatacctccgaattttttatcaccgaaatttacggtgacaataacccctattattaccgaacactgtttgttgtactttccaatcatcagacaaatatttttgatcagtcatttcataatatccggttaaataagaattttcttctgcagttttataagattgaacgaatctatttttttatatctttcccaaattgtttgattaaacaaaaacattggcggagttccatataatcgattaaacaaatctcttttatcccattgaggaattactttcgaattatgatctccccaataccaataacttataacacaatcatgataaacaagttcgaacaaaggaattcgtaaagtttcatcaaccatatattgagtttcttcaggaacataagtaaacactgtttctaaatctcttccagagttaggtactctatattcgccaggactcatcattccttcaaagaaatcgcaattaggtatagcttgttctttaccattctctgttcctacaacaaatccacgatttgtatattcctttaaaagttcgattcgtgcttctaatgacattgttcgagtcataggatgatctggatgataacattcacgataaggtgatgcaaatgtcgtatcaataaatcgtgttgtgaagttataaccagaagaaatttctttatcaagtttcttctttgcatattcaggcgctcttaagtcacataatactggacaaccaactcgtggacattcttcaagtgttgaacctgctggacatgataaattatttactgaccatgaagtaattatttgattatttttcatcaacaataacatcatcaggaaatgcatcataaaaatatgctgtcgaattacttacataacctttgataatattttcgggatccatttgatcttgataaatatcatatcgacttgaaaggatattagtcatattattattcatataattaacttcactgattgatcctccacctgatgataatattcgttcgattcctaacgattgcatttcggtatataatttgatttttattaatattaaaactaccaacagtccatacattaactgcgccaattaatttatcaacgtttggacgagtttttaattttctctgtaaatggtactaaatatcctttttttcttgcgcatatttttcgatatctttttggctatagaaacatgatttcctttctaaaaagacataacgaagttttcgaggatatgaaaaacggcctttctcaagactaaatcgtggtttaatatataaatattcttcattataacggacaacggctactgaactatcataaggcgtttcaaatattattatcattgaactttgatcatttgtttgaccaacaaatcccattgataaactataaatactataataaaattcatcacgtccaagaagttcggttaaatcaacaggaagtgtgatgccttcacagtatggaagtacaatacgatctccaagtgaagagataaatggaaacggataatctggtggaagaatttcggagtcattgttatcaagagcaactgtagatcgaaatccatcctctaaaagttcaatattaaagtgaataagattatctggtgtaattgtatcaatagaaattgaactactggtcgtttttaaatttattgtagtgccaccaatagtttgtctacgttgagtcaagttcgttgagtggttttatcataaattgtcatatttaataaaagagtatcatatgttaatttgatgtttgaattttcaagttcgacatttcgaattgtgggtgcatcgtagtgaccagttatatcccactttatagatttaaacttaaaattggtaatattacttccgacaaaacgaaatgtgaaattacgtgaatttcctggaataatccattttctagtatatgtagtatattcgccaggtgaatcaacaactggataagattgaaatgaccaatctggttcattattaaaatcgtatggaatgatttgaaatttagcatctccttttatataaaaaacatcgccagtaacagttacttcatcaccaggatgccatgagatacgaggtgatgtaacagaataatctttttcaccaatatgtgaaaaagaaaattcattatctgtttgttggagttcagtttcgcaatctcctgttgaaatgccattacaccaagtactgaaacgagtaatttcagttagagaaaggaagaaaaacagaaacaccaggattgtccaaactgtaaataaggtaattcaatgcaagaaaaacttttcactcaaaattcattatcgttctatagaaaaaaatccatcggcagctgtttacagcatcatttcaaagcattacacaactgtacaacgtttgcactttttgtcgtttttctccatgtaaattatacaagtttcacaccaaatatttggaaactcatgtccagaataatatatttgcttgcgaagtttatattaaagaagtaattacatgaggacgcattcgatcttttcaaatgtttccatattcttctgtataaaacatcacagtaattttaattaattttttagttaaattttctcctcatttcatccaagttcagcgagattcttctcagacttctcgagtatgatacgtgctctaatgactcttgactcgagctccaatctcttgagcaaactttcctttgttgttccaactctcacgacagcgccgcccttctttgcagcttcttcttgtttcttcctttgttctctcttattgttcaaagcagtttctgcggagtttgctaatgcgtttgcacctttacatattaccactacgccttctctcagtgcctttgcttcaggtgactcattgttatgcggctttgcgaatttctctccgattccatttaatcctttcattctgtcgatgactaaagtttcgggttcttcgactttcttttcttgtgaagtaattttagttgacgcgtcgagtaataatttcatttgttcagttacttcttcagttaatgaaagataactatcgacgctttcttcactacttggatgtgccttcgcatgtaacacaacatgatttacagagtcgcataaagtgataccaattcctaacatgtttgtagcatattcacgtgagatacttgacttcattgtcttgactttatcattataagtttctaatgatgatttaacttgtgttaatggatttaatacattagtgaacttagcgttaactgcattttgtgctttagcttcttcttcggctatttctaatgccttttgcgcgattttctgtgtctcttcaattgcgttcttaatgttttctctatatttcggtgattgtccatcccaatcaccacttaacatgaatctactacgtaattccttaagtaatgaatcataatttactgcaatgttactacaagtagttgctaaaccactttgcaattctaagttcatcgatatagctgaaactcttaatgtttgtaatacgacattatctatagctgtatatacttcgttcattgaatctgctaattgtgcattctttgcattagggaataatccataaaatgctttagacttttgttgataaatattaatatattcatttaacttcttaactgaatcaataactttcaaattagcagtgtctttaggtactgatggcattacataacgtttcttaagtttttcggcattttctaaatcaggtactataggtacagcatcagttaacttattaataacacgtgttaacccaccaaatgaatcacttaagttaatgaagtcatgagttaaatcaaataatgccgaatcttgtttgtttaatgttggatttttagcattagctttgaattgtccaaattgttctttaatagtaacaaataaattattaaattctttctctgcttgtttatcagtatttaattgtaataatttagttgatttagtttctaattctttcatagatttctctaatttttttcgacttgtgaattgaacattatttcaaatgtttcggggattttagattctgctctagctgtaatagttgaagataatgatttaattacatcagaagcaattctcatgaattctaatttagatttaccgatatctgatgtaggctttttgtttataaattgggatattagtatcttccataatatcaagcatcgaatcaaacattctattaaatgaacgtgtagatctacgaatagaagtagaagaaactgcagaagtcttaaggatatcaatcattgaacgtactgatattaaagaagaatcgaatattctaatacaatcattataaatcgaatcatttttcacatgatgtaacatttaatccttggaatatagctgctatagaattagagacatattcaatgatttctgcaattgcttgagtttttagatgatttatttctatttttggactgattcaattaaattctttgtagatacaccaatcttttgcatagaattagaaataactttttggacatctgtagctgtcttaagtttttcaattaattcataaggattcttagtttctttattaatgattgtaattaaatctgttcgaagttctgttaatgactttaataattcaggactaatcttaccatgaattgcataagatttttcaactaatggtaatatcttattaattttaggttccatagctttaagatatgaatcattagtaccaaatgataatgaatgaatatttaatcctttgaattgaataatttctttgttcattaaatcaatatcttgattttgtatagctttagccattgaagcaaaacaatttactgttgaagatattggattttcatctttattttcaactatagctgaatcaatattttggaatgtagaatataaatctgctaataatttcctaaagttagaagctgtttcttgtgtagatttaacacaagaagcgttttgtaatgcttcaattgatgacataatgtttaatggatttaatttaagttgagatttaacttgaggtttaagtgatgaagaaactctagaataagaagctacaagttgtggagcaatttctactaatttacggatttgattagaataagaagtagatttagaatcataaatttgattaacaatatttaatgcttctttattttctgctattaaaatagatttaacttcttctgatggaatattatacattgtagggactatagtaattaatccttgataagctgatgctactcttgaagcattttgtttctcacttgggattttaacatccattacttgtccaataattaaatcatcataattaattgatttatcaaagaatgatttaagttcatctgttaaattatctttttctaattctgtaactatattaatatctttaggtgtaatagtatctgttaaattagttaatactgtaagtcctctagtattcgtttctttagtttgtttttgataagtttgtaaaacatcttctgctttagcatcaattgtaattaatgacttaagcatatcttgataatcaataacttcatcttgtgtaaatggatctgatgtagctgtttcatatgtagaagtattatgaacaaattcatctaaacctttaatacctttaagttgttttaatttaatattttctaatttctctgttaaacaagtacgagcaaattgttcatctgataatttagatgctgttttaattttagtattagttaaaggtttaataggtgttaatacttgaattgaagatactaatgtaggcttttgatgttctatagcttgttcagtagatttaataattgtagtttgtaatgaatttgtaacattaactaatttaataccatttaatttagcatctttactttctttagattcatcagtaattatttgttgtaacattacttgttctactattaattgatctttattagtatgttctaaaatattatttaatttagaattatcatttaagactttaacttgttgaattaaagaagaactaaacttaggtacatcattagctgtaatattcttaagtgcattattcttatcttcatctgtaattgatgctaacattggatttaagtcattacgtgcttccattaatttaataagtttattttgaacacctttaactataatattttcttgaagtgatttaactttcttttcaatttgatctgctttttcgatttgtggtaaatcttttgtagacacagatactatacctatacctggttgacgttgaatgattgcagccatatcaaatatacgtgattgtttttgtaataattctgctatataaggatcgaatttatttaatttagaaacttctttaactaataatgaatatacacgtttttgatcatctttagttaaattattaattaaatctgtaacattagataaattactagaagataattcaattaatctttctaaaattgctcgtgtagtttcaagttgttctgatgaaaatgtaggtttagctgttaatatttgtttcgataaatcaggtgttatagtattaaatgttttaagtaaagttttaacttgttcaatacgattaagattagttaatttagaattagtcttttcataaccattcataatttgtgaatcgataagtggtttaataccatctaaaggtttagtagtctttctaagtaaattattttgttgatcttgtaattgattaaataattgattcattttactatttaagtcaattgatttattaatacctggacaatatttattaagtaattctggattagttaaaatagatttaattgctgataatatttgttgttgttctaataattcttgagctgaaagttgttgagtaagttgtaatattttagttggatcattaaattgtgtaattaatgatttactttgcatagatatttgtctagcatttaatatattactattagtaggttgatttaatttaggtataatttgagctgcattcttatttgtagttaattgtttttgttgaatatcagaaatcttttgcatacaagttaatctattaagtaaatcataagaaaattgttgtgcttctaatatatcagaaggattaacataataatttaactttaagacttctggattttctttaataatttcttgttgtaaagaatttaatgaagcaaaaatagctgttttagatacatcatctttaccagattcagatgacattaaagattgaccaaattcaccagttaataactttaatgaatgttgtaaaatcctttgttgaataataatttgttctggtaataaattcttttggaatgcatttaataattctggtgaagatactaaattaacttgtttaagaatattttgttgttgttctaataattgatgtggtgtaattggtgaactaagtaattgtaaaccttctggtgattgtacaaatttaaataaatctggaatattaactgataattgttgttgaatagtaattaattcattaattaatgctaattgtgaataacctctttgaattgaagcagataaatcatcagatttaattgaagtatttggtaaattacctgtttgaagtttatccattatagatttaaataattgttgttgaatagcattagtttgttcgacatgtgattgaattggtaaatcaacattacgatcgatagcttgagttaaattatgtgttaataataattgttgtgataatatttgatctggtgataaacgtgattgtaatttatgtaattctgatgatgattgtaatgcttcaaattgttgttgaatagaattaatagaagaacttgcttgatctgaagtaatattagtaattggtaatactttagaattaattgatgaaatatttttaactacatctgggaattctgagatttgttgttgttgtaattgtgatatacgttgtgataacattgtacgttctatttgtgctattgtagaattttgtttatcagtagtaggttcatctgttaaatatattaaatcttctaatttatttaataattcatcatattctttaggatcaactgatattattggatcatttaatgattgatcaatattacttgaatgaagtgaatgtttaggtaattgcattgttttaccatttgataatttaatatctaatttagtattaaatttattagtatctgaagaacgttgttcattacttaatttaggtattgaagctattaatttctctaaatatttagctgcttctttaactaagtttaatgcttctttatcagaaatcatactaaataatgattctaaatctgatattttatcgatttcatcaatactattataatcgattggtataactttatttattaattcttctgattgtgttaaacaatttattaatgattcaatatctattttagtttgtgatggatttttactatcaataatacttttagctaattctgaagatttaatagatttttcatgaacttctttaactggtatattcttatctatagcatcagttaagttttgtaataaagaagaaattttagcactacctaaagcaaaatctaaaggtatttcttcaggattattttcattagtattcttaatattatttgtagatttaatagaagtacataatgaagaaattacattagaacgtaatccttgattagtaagattttgtattggactttgccaatatttaataattggtttaatcttttctaatgcttgaatatgattttgaagttgtttagtatcatctgattctggtaaagcttttaatatttgtggatataaatctgattgataattaattattaaattagataattgtttaattgtaggcatatcataagaaatacctctttctttaaacttaagatttgatactgcttgacgtacaaaaccagataaagcagcaggtaatttatgagatttatctttagatattaaatcttctgttttagatactatatcatctatatgattttggaaataagccatcatagataaatctgtttggaatacccaatcactaaaatctttaccacaatcttgtaaaggttgtacaataggtttaatagcagcaatatttgaaactttctttaataataattgtaatgaatcatcaatattatgtaatggttgataattaaagactgctgtaggtaatgattggcattgtaatattaatgaagtatctgaacgtttaatagcattttgtaatttagctaaataaaacttagtttcatcatcaaacatattcgaaaattgttcaactctttgttctaagaattctaatgatttttctaattgtattaattgtaatgctgctctaacagaagttttaacagctaatttctcataaagatcattagctaaaccttcagaagaacaagaaattactgttcttaaagaatcagataatcgaactaattcatgagtttgcattgaaggagtaattaataaagcagcatgagaaatatatactggaacttgttcttgatgatcattaataaatcctaaattatcagtaagattttcaaataattctggttcaacttcattatttctagattcaaatgcactaaatgtttgatctgctaattctttaacttgtttatcagataatattggtttcttaagtttaatagcatcagaatatctaatttctactttctgtaatgaagtataatcatttaataaatcaaataatttattaacagcttgtaaataactttcatgatctggattttcttgtaataatggtattaataatgaagtagattgatataattcatcaagtgtcatttgtaatttacgaggtttatcaattgattctggtaatataactatagatttatcaattgtagtatctaaagttttagaataatctaataatgcttgattagatagaacatcttgacgtttaataaattcatgtgattgaggttgaatcttcttaagcattggtaatactgtatcaacaaattctttagaagtattaagattaagatgtggattttctaatatatgtaatatagtattaatattatcattaactatacgtgtattacgtccgatataaggatcatgaataataggtgaaattaattctgatgaagatattacaaaattcattttttcttttaagtctgataaagttttcattaattgattttcatctgcatctggtttaaattgatctattttaactaaacctaattgttgttcaatttctgttgtaagtttaagtgcattaggtctatcatataatgtattagtatcaactaattctttatagaattgacgtaatgattcaatttgtttaccaagtttaggtattgattctgataattcttcaatagcttcaatcttagcaaattgtgatggatcactcttaggtctctttaatcctggtaattgtctaataccattaatagcattatgagcagattctgctaatcgacctaataatttagctaaatcttcaatttctttaggtgttaaacattgtctaagatctggaggaatttgtgcatatttatctaataactttaacattatgtttttatcttctgtagcatgttgaataccatatttaggatcattcaaatgttccattaatacattatatgaagttatagcattatctacccaatcatttagtatagttgaagctatttgattttgtttaactttaggattatttaaatgtcctttaaatacatttgaacattcatttaatattgggacataattacgtattaaattcttacaatcttcaaatgtaggaataatttcttgtaatgtttcacctaatacattagataattcattaagtcgatcttgatgtttcttattagctttaaatgcttgaacttgtgataatgttggtgtgatttgaataagttctttttcaagtttagatgcaagtttatataaattcatattaggtttagtagccatagcacgtaattctttatctatttcatcatttaatgtaatatatttaccaaagatactcttcaaattttcattttgtgatatttctggtaatttctctaattcttgtaatgattgttggaatccatctaaagctttttctaatgcatttaccatattttgtgtaggtaatcttctaaatggttcacatttagcttttcttatagcatttaatgcatcgatagccgaagttaataaatgattagtcatttgttcaagttgtaaattattagttaaatcagatactttacgtgatgtaggttgaatacgttcaacaatttgttgaagtttatttactacatttacagcacttaaaatattttcattagcaaaaggtctttcatgtaattcatctctagtttgaacttgagttaaataatttgtctttaattgtgtagcttggaattcaagtttttcatgtaattctttattaattttaatataaggattctcagaactaatagccattaaattaagtacacgtgcagtttctccttgaagttgttggaatttctttaaatgatttagatgtgaaaattcttctgataaaggttgttcacttaaagtagatttaacattagtaattaaacgttcatataaaacaggataagtaggatcattagttatatcacttaattgattaacaaaactatgaatttcaggtaataaatcatgaacttttaatattgattgttgtgcactatatacacattgaccacttgtaggattattcataaagtttggtaatattttatcaatagtatttaagacatctttaatttttcctactgaatgacctaatgaagtacgttgattatctgtaagttttaatataatttctggtggtaatgaagcataacgattccaaattgtagttaaatcatcggatacacgttgaacattttgtggtgtaatattaactgtacttaatgaatataagattttagttaattcaggtacatcttgttgaagtttttggatgaaacttgttaaacctaatgggacattagacattttagaaaattgttgttctaataattgataattttgtaatgtattttgtaatgcttcaattgcttgtgtacgattaccatcatttaatgcatcgatatttaagttttcaaatgctatttgtaatgattgagaatcatgatctaattcttctactttaggacgtaaataagaagttatcgatttattagaagctatttgttgatcattcattaattgtgatgaagttattacattattttgaagtatttgtattgccttttctaataatcgatgatcacctggataaaattgatagaattgtgtagttctatcttgtttataattatttaatacatctgattttaataatgattcaatttttccaattaaatcatgatataagttttctatttctggaatattaatacctttttctttagctttagtaataacattaccaactgcatttaattgttttaagatatcatttaattgaggaattaaatgtttacgcatcatttctggattaccattagcttttaataaattagaagctatttgtgttaatgtagaagaagacattaataattgttttgttaattgattaggattatcaaggaatttagcatataatggataattcttttgtaattgtgtcactaaaatttcttgtaaatcagaaatatttaataatgcattagctaaacattgatcttctcttaaaggtgaaactcttactggtattactgaacctgcatcagtagaaacaaatgaattcctaagtttaatatctaatgaagataaagctaattctaatttctttttagctggttcaatagcagctttaagttcattaattttacttctaatttcacctatataaggagtaatatctaaatcattacctgctatatcttggaatcttttacgtaatgaatcaagtgaatctaataaaggtaagaagatttgtttagtttcatcatcacaaccatctaaatattgttttaattgatcatgtaaaaagttaagttgaccatataaatcattaggatcagaagtatttaatccatcactcataatatttaattgatctaataaagcatctaataaaccatcaccacgtttatacattaaagcatcagaaagtaatctccaatcaatattatcttctttcttattaaataatttatcatcatattgtgtatttaagtcatcaaatgaatctgctggatttacatcagtatcatttaataaagcattacgatctaacatatttaatatatcatcataaccttcattaatatcatctaatgctatatctaagaaattagggaaatctctaaattctggcatattaagtaattctattaaatcattaataaatgaataaatttctcgtgaatgttcttctgattctatttcaatatcacaataaataccattttcatcattaaatgttaattcaacagtatcttcatgtctaagataagaatttaatttaggccaataaataatacaatattgtttttgtttttgtactccattaatagtaatattataaggtgataatgatatagtacattctcttctagctttcttgttgacattaataatatcagtataataacatttataagtttctgatccataacctactaaattattagctaatataatataacgaaccatagaattaattggtaacattggtacaactgaatttgctgctgctttaaatcttcgtaaagtttgttgttgaacttgaatatttaatggtaataatttacttaaatcatatgtattcatttctgctactttatttaatacttctgattgttgagtagattctgcatataaacttaaaatagctaattgaaatgcttgttcttcagccattgtcattataccagataaagccatttgtttaacatctctataacctgatcttaaagtttgataattccgtaataaatctaatgagaataataagaatcttcgtttaagtaatacttccacataatttggagtcattaaaggtatacaatatttaaagtctaaaggtcttctttcacctcgtaatacttcatataaagtataacctaaatgtgtacctaaattaaaatgtcctgctaattgtttacaatgtgtaaagatatctcttctaatttctaattctaattctgtaactcgattaattgtagtcattacttgtatagttggtgctatagctataacaaataaatatgaattatctactggatttacatcttgaagtatttgatcttgttctacccaattatattcattatctttttctttcttcctacgatgatttgttgtcattattaaatgtaatttacgattaggataagttaaatcaaataatgcaattttagctaattctattggacgaagattcttagatatttgataagaattaggtgaaggatgatcaagttgtctttcaatgaacattttaactgaattattcttatttcgttctaatatttctaacatatcagaactattcttagaacgttgaatcatatcacgttgttctaaacttggtaaccaatatttcttataagaatcaaataatttaactaatggtactatattatttgagattatagtaatagtatgtaatgtaccaccttcttctgtaacacgtaagaaaattcgatctttaatagttgtataacttgcaatatttcgataatcaatttttgcgagatctgtttgattacttggatcatataaatgaataccgaatggtccaatagagatattaatcttcctcttctttttagatttcttagcagatttaatatctaaatctgatttttcatctatagaaccagtaaatatttcacaaccccaatgatttaatgcacgtgcagttaatatatatttaatagctgcttgactttgagtgaattgacttgaattaactgatataagttctttaattttattaaagattttatttttaagtttataagtttgaggtaagaatttttgtatatcattcatttgtaatttattagcatcttctggtgaattagatatagctaatgcatgataaacagctaattcaatagcagtattatcattaatttctggtataccacttaatatatttcggactacatcagggaatatttgtaatgatgtataaggtgaagtaatatcttcttttgtaaataagaaaactcttcttctaaatgtcatcttatcgaaatctaatacttgttcaggaacagtcctagctaaatctaatgcaaattcaccttcttcatctctagcatataaagtataacctaatgggaagtctacatacatcttaaaagcaatttcatcaattaattgttcaactgtcttttcaatattaattaacatttgtcgatcaaatgtatctgtatgaatttgaactggcatataagtataatagatatgaattgtaactccatcaaatgcatttaatgaacctaagattgtatcatctttaatccaatggaattcatcatctgatattctaagtaatgctgaatattgaccggtaggatctatacctaaatattctgctgcttttcgtataacttcactacctttatctctcatatcataagcataaggttgtgcattctcaaagtcttgacaaaatactgtaattaattcgacacgatctgaacttgcaatttcattttcatcttgaatcttattcattaatatttgcttatgaatatttaagaaacttaagattaatgatgcaatttcttcggctgattctgattcgatattacaaaatgaagccttaaaatcttcatcacaatatttcattgataattcattaccaaatgtttctaatttaacaaacttcttatatggtatcattactaattcattcttcttattttcatctgtaacaaatactcgataaggtcctacaaataaaataacatttgtacgaactttattaccattcttttcttctacaagaattactgggaattcttcacaaccaaattgtggtaatgaacgtgctttttgtatatatttaaccatagctttatatttatcatcaattggatctgattgtaagaattcaatgattttatttttgccttgtttataattaattttcatacctttaggataatacattgggaaactagtttcagatggtactgttgtaggtgttaatactgtaggaccatcagctactaaagcataatacattaattctaatgcattatcttgacttaatgctaatctacctgataatattaattcacgaacatcacaaaatgcttgatataatgatactggatcttcaagttcggattttgtaataatgaaaaatcttcttctaaattctaattcagaataacgtgtagcttgttcaggtattgagatatttgtatctaaaggtttaggtggttgtccatctttagaaggtaaatataaggtaaaacctaaataatgtgctaaaccattacctttagctacgattggaataagttcttcaacttttttaacaattggtaatatcattactttagttttacccattgagaaataaattttaattcttggaaatgcttcaataataaataaaattgttccacggaatggattagctgatgataaagtttgatcatttaatacccatttataagattcttttaagatccataataatattgcatattcaatcttaggctcaagtttcataataggtataagtgtttctgagacttctttacctgtacgaatagtttctaaccaaacttttggtaatttttcacgtttctctaaatcatctgatacaaagaaatcaagcatagcttgacgaactacaccattttcatcgacaaatccaccacgtaatcttttagctatatcttcttgttctttttgttgtttcctttgtttattaagcattaaatctctaatgattttaatattataatttaataacattaatgcagtattaatttctcgtaatttaatttctaatgatataattttcgatgtatttgaatctacaaattttaagactaatttatgacccatagattgaaatgaaactataaatcgataagttaatgaataaactggttctttaagatttgctgctaaaaatataaagattctcattgggcctatagctataacacatgattgaggtctagaaactgcaccacgtgtaacttctgtcattaaaccttggaatcgttcttcaccaaatccttgtaatttacggactttacctaaataaagtttcgaagctctatgtttttctatttcttctgattgttctacagcttttctaaatttagcatcaaatttcttatctactttaatataaggcggaattaattcatcatatttaattgatttaattaatttaacttctttaggtgaatttgcattagcatataaataataaatagctaattgtattgctaattcttctgatatcctaacagtacctttaggatctaataaagcactcttacaatcacaaacagtagtaaatgctgcttgatctgatgaaagaacttcacctgaaagtacatataatcttcgtttaaatactaattgatcaaatttagtacattgttctggtatagagaatcgtgtatctaaaggttgttgttcacctgttttttcatcaatagtataaagtgtataacctgcaatttctggtaatgataacttttcaaataacattgggataatttcttcaatagttttagtaatatccattaatactgttttagtactaccatctgcaaataatattttcattggttttttgttcttaagaatatatacagtcataccatcttgaacattagctaaacttaagatcatatcattagtaatccatcgataaggattttcttcattaatttaactaatactacatgatcatcatcatgtggaatatttaaatattgttctgcatattgtaataatgttttcccagtaaatttagaatcataatcatatgacttaggttcaactgcatctaattcagatgctgtaaataatgatattttacttcgtggatcaatagctgctacaccttctccaaattcggctgctcgagcttgagctctttgaataagaatttgttttgatacatctgaatattcttcaattaatgttttaatttttggtacttcacttgaatgtacatatatttaccaattttacctaatgatctcataatagaaaaattggatttctaattgatgtgataataaattcatacaaactattctcgaaattgatatcttttcttcaattgttcctgtcttaggattaattaatgtaatagttaatggtgatattaatactgttacttcaacaactgtcttctttccttgaaatttaagttcgattttaactctgtcgaatttcttggtagcaaatccttgctatacgacgtaccttttgaatgaactttctacacccattaaattggtcaagttttccaa

SEQ ID NO: 30 - protein, 610 aa, Histomonas
  misc_feature: HM-G8794-VIR
MEITSQEFDLSNQSFWAAVTFERIQKSLNPNLVLINLSTNHVNYESAELLSNLMIESKTLLYLNLTETHLVRRSSDIIFEALGDSSILEFYADDNIFYDESCQKLGESLQKNPPLQLLSLCGCDISSKGCISIVKGISKDSKITDLRLESNSLFDYGATEVANIIPASNLTLLSIADNEIWSEGTNNIIKAVRGSTITALDLSYNVVDLKNLTSLLVDFDNIQAISISGCKVSEKDFPTFISSLPKTKLRTLILESLNFQPIPISWPEVPDTLWTTYFDIFLSSLSEFQTIEDLRLGFMNLDQLYKVKSTLERLRQEPLTISFKDFGRTNDCWIYHFPESTYESPDTIMQWRDSITVHNAFFIGHIINHTTASNNRQIEILNLSQCQIDDEILSKIINSIDGHNLKSIDLSDNNGITDESVEYLLQYISQSQLESINLYETKITDSGYDRIFSLPLLPLKNISLSFETHQLNEDQHHQFFSSIASLLRTQECVLEDLRMTGYITPVDAKEIVESLHENTSLRHLEIDSLHCEKYENPDPVIDPNIQSLYDDFTEALADAVMGEGTSCRLCSLVYPLLTEVYVFSERGMKIFADIEDKLKENMEMYGKDNE

SEQ ID NO: 31 - protein, 265 aa, Artificial Sequence
  HM-G337-ATT
MEITSQEFDLSNQSFWAAVTFERIQKSLNPNLVLINLSTNHVNYESAELLSNLMIESKTLLYLNLTETHLVRRSSDIIFEALGDSSILEFYADDNIFYDESCQKLGESLQKNPPLQLLSLCGCDISSKGCISIVKGISKDSKITDLRLESNSLFDYGATEVANIIPASNLTLLSIADNEIWSEGTNNIIKAVRGSTITALDLSYNVVDLKNLTSLLVDFDNIQAISISGCKVSEKDFPTFISSLPKTKLRTLILESLNFQPIPIS

SEQ ID NO: 32 - protein, 612 aa, Trichomonas
  misc_feature: TVAG_187350
MEEGEKCLDLSGKRFSGGQLLKELKEYLHADVTRLDLTTNQVTPEVAQFLANFLTAPGCCLVSLSLVDTRMTIEACSAIFKVIGASPLIELYADDNVIKPESLMLLANSFKFSSPLEILSLVGCDISSEGFEYVVKCLSETKNLHHLRMESNSIYENGVRLLGEALDASSLTSIEIADNMIWMGGMTSFLEKAMTYPSLTALDISYNAVDLTFLSKVLVSNTSITHLAISGCKVNEQSVLPFIESLSRTHLKTLIMDGFNYQVLPISWPQVNDTIFFKHLNFEAFTTALISSDYLEDVRIGYLELEQIHALEQSLSGENISKSIKISVHDFGRTHDCWVLNFPAFSVDSPVDLIKWCGKLDDTNATYFGRIAVCALYRDDRLSKINLSSKNISDSIFIRVMKELDGRNLTSLDASDNALGNESVDSIISFLHNQRINELNLAKNHINEHGTGRLFKFFNENPDRCPRVLEYHYHIQNDNNELNDHQFYNDLANFLKQNMSLQTLKISGTITPIDVLKIVNSLKDNNTLQILEIDSEFIHTYMNPDPQPERKFIDEYVKLVKALKAVLYDGNCVLQNFKFDLLTEVFIYCDQEIVECWDSCLAKLKKNKNGRK

SEQ ID NO: 33 - protein, 609 aa, Trichomonas
  misc_feature: TVAG_39360
MNDNVVDASGMQMWNAMTLSFVKEKLTDKVTYLDLSTNHVSLECAEYLSKYIGRKDSSLIGLSLINCHLTVRASKVIFEAIGNSNLIEFYVDGNILPQEACEILAKSLQKNPPLEVLSLNGCNIASEGGVAIAQSLPSLTHLIHFRIESNNLFDPGACAIAKSIRNSTFQYLSVADNEIWLEGTNAIINEIACVPRVKSLDISYNTVDLEVVTAYIAKNQQFEELAISGCKIRIHQLPPFLDKIVNSNLKILIMDGFDQNILPVSWPKIHDKIFTQPDYFEQLCNIIQISQSLVDVRIGYLDPGQIMSMASAFSTLDRDVTLSIQDFGRTGNCWVAKFPNFELLSPTDMLKWNEAVTSPEAARNFGPLFAATKYKNFTLKSMDISAVSLNDQCASKMLMGMRNLNIDILDLSSNNFGDDIVEQLIQMCSSCKLRDMRLEKTRLSEIGLTNFLSFFADVKPECCPKELSFSVVSEDKNPFSVHGVFQILSQVLIQGVEIESLCLDGAITPRDVKIFVDELMRKPVIHELSIETDMTQDYSSPDPPIDQEILLQFKDACKSIHKLICKTEGCKMRDFKYPLLTEIFIYHDHEMMEMWQEIDAKVEQNLSKK

SEQ ID NO: 34 - protein, 620 aa, Trichomonas
  misc_feature: TVAG_114550
MEEDDENIINASDKGLWNAMSLSFIKEKLTDNITHLDLSSNHISVESAQIIAGFLSKKDSHLQGLALVNSHLSTRASKIIFEAVGSSKLYEFYADNNILVQEACEVFGKALKNGPPLEVLSLCGCQIPSEGGIAIAESLPSLKNLMHLRLESNSFFDFGAQAIAKVLKDTKIQSLNIADNEIWLEGTNELLEAVANSKFMKSLDISYNILDLDNLAKCVLANTNITELAISGAKIPILQLSSFLEKMVNSNLQILIMDGFDPNQLPVAWARIQDTIFKQPEYFDLLQNLILNSKTLVDVRVGYLELDQIATMQETFAHLKREISVSVHDFGRTGNCWVFNYPEFTVLSPTKLFKWGEPILNPNSAFQIGNIFSSAKVDGEMLNSIDVSGCQMTDECMNQMLSVLRRLDLDILDISNNNFGDEVIEQLISMAGSCKVRDFHCEKNKITDIGLELFLAFFAKELPENCPKELSFTVISEDKSPYSVHPVFQTLAEIVKQGCDIESLCIDGQITSFDVKTVVDEFPVNPVIHELSVETEMMKDYSSPDPPIDETITRGFIDLYTSLHKLICETEGSVLRDFKFPLLTEIFLYCDATGVKLWREINAKLEENFNKYKESLNNNK

SEQ ID NO: 35 - protein, 688 aa, Tritrichomonas foetus
  misc_feature: Tf-OHS97862
MLEQRNIEKLPIFPTLIGENFHLELKKEMADCDDDQRDAEILVNAAKQSMWGTVTLNFLKEHVLNGIVSLDLTTNLITFESAEYLSTILKNPKSSLKYLSLIESRLTQKAADIIFESIGDSTLIEFYADDNVFPEEQCKVLAESLKKNPPLELLSLCGCDIPSGGGIAIAEALPSNSHLKHLRIESNSLYDFGAKKLGEVIPKSSLISLNIADNEIWAEGTTAILTNLKFSQVESLDLSYNIVDLNVLNEEIEKTKIKDLALSGCKVHEQLFPAFLGKIPTMRLQTLILDGFNFQTLPISWPRVKDTLWSTCAYFDDLMLALQQSQTIVDLRVGFLDMDQIFGLKRLIEDGPERSITISMHDFGRTGNCWVVHLPEFKFEAPCSTFRWNSSITLDNCELVGSVIQNATVFPSSDTSDTPAAPTNTITSTHTKQTGKSSKSKGKEHKNHQNVPIIPTNKIDTVDLHDMKLEDDVFIKLLNSMNGYNLKLLDCSDNNLGDASLDAVRNFLKETHINELDFSGNASSDLGCETFIHNLLEDNITVPQKLSLCFKSTDLGELSGHSTPNMIAELLKENVNIESLYLGGPVTAADALAIIDAIPHNSHIRELEFQSDHIKNYMNPDPEINQDVQGQFIVLASLIHSALWDKKSMCKLKSFTFPMLTEVFIYHEDICSQWLDVEKKLAQNALKK

SEQ ID NO: 36 - protein, 616 aa, Tritrichomonas foetus
  misc_feature: Tf-OHT01931
MSDRKEKEAEIDISGKNMWNHQTLNFLQSNLNDSLIRLDLSTNHLSYESVELLSNHLKNSKNLQYLCIIQTQLIQRSSVLLFESIGHSNLIELIADDNIFPTEPCKALAASLELNPPLELLSLNGCDIPDEGVVALAKSLPKNKNLKHLRLESNSMFSVGAQALGDVLPESHLLSLCIADNQIWNEGTFSIITNLDQSHLTCLDLGYNIVDLKMLSEKVAMSKVSQLGLSGCKVNEQQLLSFLSSIPSLNLETLIMDGFSKQMLPISWPRVHDNIWGTRTYFDCFLNSLKNSPKLSDLRIGFFDLEQIFTVNKALEGRTEELTISFHDFGRTDDIWLLKLPGPRFESPTTVFRWNDQINTQNCHYIGQIILNTKVNDKDKIETLDFHELHLDNSVFSNIIHSLKDFPIRHLNLNDNNLNDESLEILANYLKQIKLSSLDLRSNSRITDDGCYQFIQSIKDKSIFPRKIYLNFRSTDMGEYSKHKMSEAVAEIVKENFSIELLSISGPLTVADALEIVSELKHNSHIREIEFSSEHTKIYANPDPELKPDLQENFISLVNVLHDCLFSNDSVTKLRVFNFPLLSEIYLYHDDIYEKWIEITERLKSHHKSSSSRKDK

SEQ ID NO: 37 - protein, 597 aa, Artificial Sequence
  Consensus
  misc_feature (4)..(4): Xaa can be any naturally occurring amino acid
  misc_feature (6)..(6): Xaa can be any naturally occurring amino acid
  misc_feature (9)..(9): Xaa can be any naturally occurring amino acid
  misc_feature (11)..(11): Xaa can be any naturally occurring amino acid
  misc_feature (18)..(18): Xaa can be any naturally occurring amino acid
  misc_feature (20)..(20): Xaa can be any naturally occurring amino acid
  misc_feature (23)..(23): Xaa can be any naturally occurring amino acid
  misc_feature (29)..(30): Xaa can be any naturally occurring amino acid
  misc_feature (49)..(49): Xaa can be any naturally occurring amino acid
  misc_feature (51)..(52): Xaa can be any naturally occurring amino acid
  misc_feature (57)..(57): Xaa can be any naturally occurring amino acid
  misc_feature (68)..(68): Xaa can be any naturally occurring amino acid
  misc_feature (82)..(82): Xaa can be any naturally occurring amino acid
  misc_feature (95)..(95): Xaa can be any naturally occurring amino acid
  misc_feature (99)..(100): Xaa can be any naturally occurring amino acid
  misc_feature (106)..(106): Xaa can be any naturally occurring amino acid
  misc_feature (122)..(122): Xaa can be any naturally occurring amino acid
  misc_feature (135)..(137): Xaa can be any naturally occurring amino acid
  misc_feature (140)..(140): Xaa can be any naturally occurring amino acid
  misc_feature (152)..(152): Xaa can be any naturally occurring amino acid
  misc_feature (155)..(155): Xaa can be any naturally occurring amino acid
  misc_feature (159)..(159): Xaa can be any naturally occurring amino acid
  misc_feature (165)..(165): Xaa can be any naturally occurring amino acid
  misc_feature (178)..(178): Xaa can be any naturally occurring amino acid
  misc_feature (183)..(183): Xaa can be any naturally occurring amino acid
  misc_feature (188)..(188): Xaa can be any naturally occurring amino acid
  misc_feature (193)..(193): Xaa can be any naturally occurring amino acid
  misc_feature (195)..(195): Xaa can be any naturally occurring amino acid
  misc_feature (210)..(210): Xaa can be any naturally occurring amino acid
  misc_feature (214)..(214): Xaa can be any naturally occurring amino acid
  misc_feature (219)..(220): Xaa can be any naturally occurring amino acid
  misc_feature (229)..(229): Xaa can be any naturally occurring amino acid
  misc_feature (233)..(233): Xaa can be any naturally occurring amino acid
  misc_feature (235)..(235): Xaa can be any naturally occurring amino acid
  misc_feature (240)..(240): Xaa can be any naturally occurring amino acid
  misc_feature (242)..(242): Xaa can be any naturally occurring amino acid
  misc_feature (246)..(246): Xaa can be any naturally occurring amino acid
  misc_feature (270)..(270): Xaa can be any naturally occurring amino acid
  misc_feature (277)..(278): Xaa can be any naturally occurring amino acid
  misc_feature (281)..(281): Xaa can be any naturally occurring amino acid
  misc_feature (291)..(291): Xaa can be any naturally occurring amino acid
  misc_feature (295)..(295): Xaa can be any naturally occurring amino acid
  misc_feature (304)..(304): Xaa can be any naturally occurring amino acid
  misc_feature (307)..(307): Xaa can be any naturally occurring amino acid
  misc_feature (311)..(312): Xaa can be any naturally occurring amino acid
  misc_feature (314)..(314): Xaa can be any naturally occurring amino acid
  misc_feature (319)..(319): Xaa can be any naturally occurring amino acid
  misc_feature (327)..(327): Xaa can be any naturally occurring amino acid
  misc_feature (332)..(332): Xaa can be any naturally occurring amino acid
  misc_feature (338)..(338): Xaa can be any naturally occurring amino acid
  misc_feature (343)..(343): Xaa can be any naturally occurring amino acid
  misc_feature (349)..(349): Xaa can be any naturally occurring amino acid
  misc_feature (353)..(353): Xaa can be any naturally occurring amino acid
  misc_feature (358)..(358): Xaa can be any naturally occurring amino acid
  misc_feature (361)..(361): Xaa can be any naturally occurring amino acid
  misc_feature (364)..(364): Xaa can be any naturally occurring amino acid
  misc_feature (367)..(368): Xaa can be any naturally occurring amino acid
  misc_feature (370)..(370): Xaa can be any naturally occurring amino acid
  misc_feature (372)..(373): Xaa can be any naturally occurring amino acid
  misc_feature (377)..(377): Xaa can be any naturally occurring amino acid
  misc_feature (383)..(384): Xaa can be any naturally occurring amino acid
  misc_feature (388)..(388): Xaa can be any naturally occurring amino acid
  misc_feature (393)..(393): Xaa can be any naturally occurring amino acid
  misc_feature (398)..(399): Xaa can be any naturally occurring amino acid
  misc_feature (417)..(418): Xaa can be any naturally occurring amino acid
  misc_feature (420)..(421): Xaa can be any naturally occurring amino acid
  misc_feature (425)..(426): Xaa can be any naturally occurring amino acid
  misc_feature (428)..(428): Xaa can be any naturally occurring amino acid
  misc_feature (435)..(435): Xaa can be any naturally occurring amino acid
  misc_feature (437)..(437): Xaa can be any naturally occurring amino acid
  misc_feature (439)..(441): Xaa can be any naturally occurring amino acid
  misc_feature (444)..(444): Xaa can be any naturally occurring amino acid
  misc_feature (449)..(449): Xaa can be any naturally occurring amino acid
  misc_feature (451)..(451): Xaa can be any naturally occurring amino acid
  misc_feature (455)..(455): Xaa can be any naturally occurring amino acid
  misc_feature (461)..(461): Xaa can be any naturally occurring amino acid
  misc_feature (463)..(463): Xaa can be any naturally occurring amino acid
  misc_feature (465)..(465): Xaa can be any naturally occurring amino acid
  misc_feature (468)..(468): Xaa can be any naturally occurring amino acid
  misc_feature (473)..(473): Xaa can be any naturally occurring amino acid
  misc_feature (475)..(476): Xaa can be any naturally occurring amino acid
  misc_feature (480)..(480): Xaa can be any naturally occurring amino acid
  misc_feature (485)..(485): Xaa can be any naturally occurring amino acid
  misc_feature (493)..(493): Xaa can be any naturally occurring amino acid
  misc_feature (501)..(502): Xaa can be any naturally occurring amino acid
  misc_feature (509)..(509): Xaa can be any naturally occurring amino acid
  misc_feature (512)..(513): Xaa can be any naturally occurring amino acid
  misc_feature (520)..(520): Xaa can be any naturally occurring amino acid
  misc_feature (524)..(524): Xaa can be any naturally occurring amino acid
  misc_feature (528)..(528): Xaa can be any naturally occurring amino acid
  misc_feature (533)..(533): Xaa can be any naturally occurring amino acid
  misc_feature (536)..(536): Xaa can be any naturally occurring amino acid
  misc_feature (540)..(540): Xaa can be any naturally occurring amino acid
  misc_feature (548)..(548): Xaa can be any naturally occurring amino acid
  misc_feature (551)..(552): Xaa can be any naturally occurring amino acid
  misc_feature (558)..(558): Xaa can be any naturally occurring amino acid
  misc_feature (563)..(563): Xaa can be any naturally occurring amino acid
  misc_feature (572)..(572): Xaa can be any naturally occurring amino acid
  misc_feature (578)..(578): Xaa can be any naturally occurring amino acid
  misc_feature (580)..(580): Xaa can be any naturally occurring amino acid
  misc_feature (582)..(582): Xaa can be any naturally occurring amino acid
  misc_feature (584)..(584): Xaa can be any naturally occurring amino acid
MEEXDXSGXSXWNAVTLXFXKEXLNDNLXXLDLSTNHVSYESAELLSNXLXXSKSLXYLSLIETHLTXRASDIIFEAIGDSXLIEFYADDNIFPXESCXXLAESLXKNPPLELLSLCGCDIXSEGGIAIAKSLPXXXNLXHLRLESNSLFDXGAXALAXVIPASXLTSLSIADNEIWXEGTNXIIKAXRGSTXTXLDLSYNIVDLKNLTXLLVXNTNIXXLAISGCKVXEQQXPXFLSSXPXTNLXTLIMDGFNFQPLPISWPRVHDTIXTTPYFDXXLNXLQNSQTLVDXRIGXLDLDQIFTXKSXLEGXXRXITISXHDFGRTGXCWVLXFPEFTXESPTXLFKWNXSITXPNAAXIGXIIXNAXXNXEXXDLSXCQLDDXXFSKXLNSLXGLNLXXLDLSDNNLGDESVEQLIXXLXXCKLXXLXLEKNKIXDXGXXXFIXFFKEXPXCPKXLSLSFXSXDXNEXSVHQXFXXLAEXLKQNXSIESLCIXGPITPADXXEIVDELXHNXXIRELEIXSEHXKDYXNPDPXIDXDIQXQFIDLVKXLHXXLCDTEXCKLRXFKFPLLTEXFIYHDXIXEXWXEIEAKLKENNDKK

SEQ ID NO: 38 - protein, 403 aa, Artificial Sequence
  hm-g8786vir
MSKQTAFRLEDFIVESPIGQGAYGQIYKAVEVGTGKVYALKAMNRRCLMKMKKQSLPIVEKNALIKCASTFVVRLYGTFKDDSNLYFVLELAEHGDLAEAVGDIGSLNTNVVKLLSAQIFEAICVCHKANVIHRDLKPENILLDSQNHVLLSDFGTALIEKSDSQELNRSSIVGTPAFVAPELLNDGKICYSSDMWSFGCVIFNLLTGTAPFSGQNTVELMNNITELKFNPVIKTLPKTAKDLITSLLKLDPHERIGYGEAKEGYPSIRNHAFFKGIDWNNLSNIKMPVFTKFEEEQQPTIADSMLNEGETILMNSIVDRKRLFGWKERSIFLTNQKRLLLFNNKTHEFKMAIALTNGVKVNVAQDGKEWTITWGKGQTQTFRSNDGTGGMWAASIMRESIKP

SEQ ID NO: 39 - protein, 220 aa, Artificial Sequence
  hm-g346-att
  VARIANT (220)..(220): any natural amino-acid
MSKQTAFRLEDFIVESPIGQGAYGQIYKAVEVGTGKVYALKAMNRRCLMKMKKQSLPIVEKNALIKCASTFVVRLYGTFKDDSNLYFVLELAEHGDLAEAVGDIGSLNTNVVKLLSAQIFEAICVCHKANVIHRDLKPENILLDSQNHVLLSDFGTALIEKSDSQELNRSSIVELQPLLPQSSLMMEKSVIVLICGHLVVSYSIFLQAQHLLVDKTQLNX

SEQ ID NO: 40 - protein, 400 aa, Artificial Sequence
  TVAG_179780
MELNFRFEDFIVESPIGQGAFGQIYKAIEIKSGKTFALKALNRRFLIKMKKQSLATQEKDALTKAASPFVVKLYGTFKDASNLYFVLDYAEHGDLAEAVNDLGSLNTKATTYVCAQLLEAISTLHAKNIIHRDIKIENILLNYKNYIMLTDFGTAMMTDNDDSGFRPSSVVGTPDFVAPELLNDGHICYGSDMWAFGCVIFNLLTGKAPFEGNSTPELMSNIVARKICSDIEKLPKASQNIITSLLEIDPKKRLGYNENSKGYPSIRNHPFFKNIPWDKLETTEMPLFGPFKPETATSFAEDMLAPGETIMLEGVVERKRGLMWKGRLLIITNQKKLLIFNIENKTLKSTIQINAKVKVQVAKDGKEWTLNYGDKSQLFRCKNGDAGLWASTIIKSLTTR

SEQ ID NO: 41 - protein, 404 aa, Artificial Sequence
  Tf-OHT11420
MEACQASFRLEDFIVDAPIGQGAFGQIYRATEQRSGRQFALKALNRRFLMKVKKQNQPVLEKNALLRCNCLFVVHLFGTFKDDSNLYFVFELAEHGDLAEAINDIGSLNVEVVRLLAAQLLIAMTTCHQNNVIHRDIKPENILLNANNHVKLTDFGTALINNEGTNGLVRSSIVGTPAFVAPELLNDGQICFSSDLWSFACVIFNCLTGVAPFEGETQPELMENITAIKLNPAFERLPRHAKDLIMKLLVLDPTQRIGYGEVKDGYPSIRNHPFFAEVDWKNIYSVKMPLFTKFEEEPPPTIADDMLDPGEKVVLQGEMMNKRKLSWPERIVFLTSNKRLLLFNPKNNKFKHEIKLLPGSRVEGVSANGKEWTLNSGKAQHIFKCKDGTSGMWAATIMREMLKQ

SEQ ID NO: 42 - protein, 410 aa, Artificial Sequence
  Tf-OHT17449
MNQKTINFRLEDFSVDSPIGQGAFGQIYRAVEQRSGNIYALKAINRRVLIKLKKQSQPINEKNALSLCESQNVVKLFGTFKDDSNLYFVFEMCEHGDLAEAVNEIGSLNTDVVRLLSAMLLNAISFCHSKNVIHRDIKPENVLLDNLNHVKLTDFGTAMILKNDGNQNEENNGQMVRSSIVGTPAFVAPELLNDGMICFSSDIWSFGCTMFNLLTGVAPFEGDNPAELMANISHLKFSPAAEKLPRRAKDLIQKILVLDPTKRIGYGENSTGYKSIKSHPFFGGVDFDNLMDIQMPLFTKFEEEPEPTLADEMLANDEKIVLQGDMEKKRTLGYTERLVFLTNKKRILLFKQKSQKFKGELKLAPGIRAEVSSNGKEWFITIGKTTTTFRCKDGTAGMWAASVMRESIAK

SEQ ID NO: 43 - protein, 402 aa, Artificial Sequence
  Consensus
  misc_feature (6)..(6): Xaa can be any naturally occurring amino acid
  misc_feature (32)..(33): Xaa can be any naturally occurring amino acid
  misc_feature (43)..(43): Xaa can be any naturally occurring amino acid
  misc_feature (47)..(47): Xaa can be any naturally occurring amino acid
  misc_feature (74)..(74): Xaa can be any naturally occurring amino acid
  misc_feature (113)..(113): Xaa can be any naturally occurring amino acid
  misc_feature (124)..(125): Xaa can be any naturally occurring amino acid
  misc_feature (129)..(129): Xaa can be any naturally occurring amino acid
  misc_feature (150)..(150): Xaa can be any naturally occurring amino acid
  misc_feature (162)..(162): Xaa can be any naturally occurring amino acid
  misc_feature (164)..(165): Xaa can be any naturally occurring amino acid
  misc_feature (168)..(168): Xaa can be any naturally occurring amino acid
  misc_feature (188)..(188): Xaa can be any naturally occurring amino acid
  misc_feature (191)..(191): Xaa can be any naturally occurring amino acid
  misc_feature (222)..(222): Xaa can be any naturally occurring amino acid
  misc_feature (238)..(239): Xaa can be any naturally occurring amino acid
  misc_feature (246)..(246): Xaa can be any naturally occurring amino acid
  misc_feature (262)..(263): Xaa can be any naturally occurring amino acid
  misc_feature (277)..(277): Xaa can be any naturally occurring amino acid
  misc_feature (283)..(284): Xaa can be any naturally occurring amino acid
  misc_feature (298)..(298): Xaa can be any naturally occurring amino acid
  misc_feature (311)..(311): Xaa can be any naturally occurring amino acid
  misc_feature (317)..(318): Xaa can be any naturally occurring amino acid
  misc_feature (323)..(323): Xaa can be any naturally occurring amino acid
  misc_feature (344)..(344): Xaa can be any naturally occurring amino acid
  misc_feature (347)..(347): Xaa can be any naturally occurring amino acid
  misc_feature (351)..(351): Xaa can be any naturally occurring amino acid
  misc_feature (356)..(356): Xaa can be any naturally occurring amino acid
  misc_feature (360)..(360): Xaa can be any naturally occurring amino acid
  misc_feature (364)..(366): Xaa can be any naturally occurring amino acid
  misc_feature (372)..(374): Xaa can be any naturally occurring amino acid
  misc_feature (377)..(377): Xaa can be any naturally occurring amino acid
  misc_feature (394)..(394): Xaa can be any naturally occurring amino acid
  misc_feature (402)..(402): Xaa can be any naturally occurring amino acid
MSKQTXFRLEDFIVESPIGQGAFGQIYKAVEXXSGKVYALKAXNRRXLMKMKKQSLPIVEKNALIKCASTFVVXLYGTFKDDSNLYFVLELAEHGDLAEAVNDIGSLNTNVVXLLSAQLLEAIXXCHKXNVIHRDIKPENILLDSQNHVXLTDFGTALIEKXDXXELXRSSIVGTPAFVAPELLNDGXICXSSDMWSFGCVIFNLLTGVAPFEGDNTPELMXNITALKFNPAIEKLPXXAKDLITXLLVLDPTKRIGYGENXXGYPSIRNHPFFKGXDWDNLXXIKMPLFTKFEEEPXPTIADDMLAPGEXIVLQGXXERKRXLGWKERLVFLTNQKRLLLFNXKNXKFKXEIKLXPGVXVEVXXXGKEWTXXXGKXTQTFRCKDGTAGMWAAXIMRESIKX
